US007597894B2

(12) United States Patent
Graddis et al.

(10) Patent No.: US 7,597,894 B2
(45) Date of Patent: Oct. 6, 2009

(54) COMPOSITIONS AND METHODS EMPLOYING ALTERNATIVE READING FRAME POLYPEPTIDES FOR THE TREATMENT OF CANCER AND INFECTIOUS DISEASE

(75) Inventors: Thomas Graddis, Seattle, WA (US); Reiner Laus, Bellevue, WA (US); Michael Diegel, Covington, WA (US); Damir Vidovic, Bellevue, WA (US)

(73) Assignee: Dendreon Corporation, Seattle, WA (US)

( * ) Notice: Subject to any disclaimer, the term of this patent is extended or adjusted under 35 U.S.C. 154(b) by 575 days.

(21) Appl. No.: 10/794,514

(22) Filed: Mar. 5, 2004

(65) Prior Publication Data

US 2005/0112134 A1 May 26, 2005

Related U.S. Application Data

(60) Provisional application No. 60/453,131, filed on Mar. 5, 2003.

(51) Int. Cl.
*A61K 39/00* (2006.01)
(52) U.S. Cl. .................................... 424/185.1; 530/828
(58) Field of Classification Search .................. None
See application file for complete search history.

(56) References Cited

U.S. PATENT DOCUMENTS

| 5,840,839 A | * | 11/1998 | Wang et al. | .................. 530/325 |
| 5,976,546 A | * | 11/1999 | Laus et al. | ................ 424/192.1 |
| 6,274,378 B1 | | 8/2001 | Steinman et al. | |

FOREIGN PATENT DOCUMENTS

| EP | 1 001 022 A1 | 5/2000 |
| WO | WO 97/29195 A2 | 8/1997 |
| WO | WO 00/13699 A1 | 3/2000 |
| WO | WO 01/00784 A2 | 1/2001 |
| WO | WO 01/61356 A1 | 8/2001 |
| WO | WO 01/74855 A2 | 10/2001 |
| WO | WO 02/051994 A2 | 7/2002 |

OTHER PUBLICATIONS

Van Etten et al, 1991, 266:2313-2319.*
sequence search result # 2, GenEmbl database from search 20070607_153205_us-10-794-514a-10.rge.*
iHOP, p. 1 of 1.*
Vidovic, 2004, 209:535-544.*
iHOP, p. 1 only of 15 for "ACPP".*
Peshwa et al (The Prostate, 1998, 36:129-138).*
Kono et al (Clinical Cancer Research, Nov. 2000, 8:3394-3400).*
GenBank Accession No. M11730, humane HER-2, published Sep. 18, 1995, p. 1-3.*
Rosenberg, Steven A., et al.; "Identification of BING-4 Cancer Antigen Translated from an alternative Open Reading Frame of a Gene in the Extended MHC Class II Region Usingi Lymphocytes from a Patient with a Durable Complete Regression Following Immunotherapy," *The Journal of Immunology*. vol. 168, No. 5, pp. 2402-2407 (Mar. 1, 2002).
Yewdell, Jonathan W., et al.; "Defective Ribosomal Products (DRiPS); A Major Source of Antigenic Peptides for MHC Class I Molecules?," *The Journal of Immunology*, vol. 157, No. 5, pp. 1823-1826 (Sep. 1, 1996).
Uenaka, Akiko, et al.; "Identification of a Unique Antigen Peptide pRL1 on BALB/c RL♂1 Leukemia Recognized by Cytotoxic T. Lymphocytes and Its Relation to the *Akt* Oncogene," *The Journal of Experimental Medicine*, vol. 180, pp. 1599-1607 (Nov. 1994).
Malarkannan, Subramaniam, et al.; "Presentation of Out-of-Frame Peptide/HMc Class I Complexes by a Novel Translation Initiation Mechanism," *Immunity*, vol. 10, No. 6, pp. 681-690 (Jun. 1999).
Bullock, Timothy N.J., et al.; "Initiation Codon Scanthrough Versus Termination Codon Readthrough Demonstrates Strong Potential for Major Histocompatibility Complex Class I—Restricted Cryptic Epitope Expression," *The Journal of Experimental Medicine*, vol. 186, No. 7, pp. 1051-1057 (Oct. 6, 1997).
Nanbru, Cécile, et al.; "Alternative Translation of the Proto-oncogene *c-myc* by an Internal Ribosome Entry Site," *The Journal of Biological Chemistry*, vol. 272, No. 51, pp. 32061-32066 (Dec. 19, 1997).
Elliott, Tim, et al.; "Recognition of Out-of-Frame Major Histocompatibility Complex Class I-Restricted Epitopes in vivo," *European Journal of Immunology*, vol. 26, pp. 1175-1179 (1996).
Rom, Eran, et al.; "Polyamines Regulate the Expression of Ornithine Decarboxylase Antizyme in vitro by Inducing Ribosomal Frame-Shifting," *Proceedings of the National Academy of Sciences*. vol. 91, pp. 3959-3963 (Apr. 1994).
Farabaugh, P. J., "Programmed Translational Frameshifting," *Annual Review Genet*, vol. 30, pp. 507-528 (1996).
Shastri, Nilabh, et al.; "*Major Histocompatibility Class I Molecules Can Present Cryptic Translation Products to T-cells,*" *The Journal of Biological Chemistry*, vol. 270, No. 3, pp. 1088-1091 (Jan. 20, 1995).
Ronsin, Christophe, et al.; "A Non-AUG-Defined Alternative Open Reading Frame of the Intestinal Carboxyl Esterase mRNA Gererates an Epitope Recognized by Renal Cell Carcinoma-Reactive Tumor-Infiltrating Lymphocytes in Situ[1]," *The Journal of Immunology*, vol. 163, No. 1, pp. 483-490 (Jul. 1, 1999).
Herr, Alan J., et al.: "Coupling of Open Reading Frames by Translational Bypassing," *Annual Review of Biochemistry*, vol. 69, pp. 343-372 (2000).
Van Den Eynde, Benoit J., et al.; "A New Antigen Recognized by Cytolytic T Lymphocytes on a Human Kidney Tumor Results from Reverse Strand Transcription," *Journal of Experimental Medicine*, vol. 190, No. 12, pp. 1793-1799 (Dec. 20, 1999).
Rock, Kenneth L., et al.; "Degradation of Cell Proteins and the Generation of MHC Class I-Presented Peptides," *Annual Review of Immunology*, vol. 17, pp. 739-779 (1999).
Short, John D., "Translational Regulation of the JunD Messenger RNA," *The Journal of Biological Chemistry*, vol. 277, No. 36, pp. 32697-32705 (Sep. 6, 2002).

(Continued)

*Primary Examiner*—Laura B Goddard
(74) *Attorney, Agent, or Firm*—Susan J. Myers Fitch; Peter J. Dehlinger; King & Spalding LLP

(57) ABSTRACT

Provided are alternative reading frame (ARF) polypeptides as well as antigen presenting cell (APC) and dendritic cell (DC) based compositions and methods that employ alternative reading frame polypeptides. ARF polypeptides and ARF polypeptide-based compositions and methods are useful in the treatment of cancer and infectious disease.

3 Claims, 17 Drawing Sheets

OTHER PUBLICATIONS

Byrd, Marshall P., et al.; "Generation of Multiple Isoforms of Eukaryotic Translation Initiation Factor 4GI by Use of Alternate Translation Initiation Codons" *Molecular and Cellular Biology*, vol. 22, No. 13, pp. 4499-4511 (Jul. 2002).

Jopling, Catherine L., et al.; "L-Myc Protein Synthesis is Initiated by Internal Ribosome Entry," *RNA Journal*, vol. 10. pp. 287-298 (2004).

Martin, Mickey M., "Translation of the Human Angiotensin II Type 1 Receptor mRNA is Mediated by a Highly Efficient Internal Ribosome Entry Site," *Molecular and Cellular Endocrinology*, vol. 212, pp. 51-61 (2003).

Wang, Rong-Fu, et al.. "Utilization of an Alternative Open Reading Frame of a Normal Gene in Generating a Novel Human Cancer Antigen," *The Journal of Experimental Medicine*, vol. 183, pp. 1131-1140 (Mar. 1996).

Moreau-Aubrey, Agnès, et al., "A Processed Pseudogene Codes for a New Antigen Recognized by a CD8+T Cell Clone on Melanoma," *The Journal of Experimental Medicine*, vol. 191, No. 9, pp. 1617-1623 (May 1, 2000).

Probst-Kepper, Michael, et al., "An Alternative Open Reading Frame of the Human Macrophage Colony-Stimulating Factor Gene is Independently Translated and Codes for an Antigenic Peptide of 14 Amino Acids Recognized by Tumor-Infiltrating CD8 T Lymphocytes," *The Journal of Experimental Medicine*, vol. 193, No. 10, pp. 1189-1198 (May 21, 2001).

Wulf, Gerburg M., et al.. "Role of Pin1 in the Regulation of p53 Stability and p21 Transactivation, and Cell Cycle Checkpoints in Response to DNA Damage," *The Journal of Biological Chemistry*, vol. 277, No. 50, pp. 47976-47979 (Dec. 13. 2002).

Coulie, Pierre G., et al., "A New Gene Coding for a Differentiation Antigen Recognized by Autologous Cytolytic T Lymphocytes on HLA-A2 Melanomas," *The Journal of Experimental Medicine*, vol. 180, pp. 35-42 (Jul. 1994).

Kawakami, Yutaka, et al., "Cloning of the Gene Coding for a Shared Human Melanoma Antigen Recognized by Autologous T Cells Infiltrating into Tumor," *Proceedings of the National Academy of Science*, vol. 91, pp. 3515-3519 (Apr. 1994).

Baker, Alexander B.H., et al., "Melanocyte Lineage-Specific Antigen gp100 is Recognized by Melanoma-derived Tumor-Infiltrating Lymphocytes," *The Journal of Experimental Medicine*, vol. 179, pp. 1005-1009 (Mar. 1994).

Beckmann, Matthias W., et al., "Detection of the HER-2/neu Proto-Oncogene Protein p185$^{erbB2}$ by a Novel Monoclonal Antibody (MAB-145 ww) in Breast Cancer Membranes from Oestrogen and Progesterone Receptor Assays," *The European Journal of Cancer*, vol. 28. No. 2/3, pp. 322-326 (Feb./Mar. 1992).

Moll, Bernice, et al.. "Inverted Ratio of Inducer to Suppressor T-Lymphocyte Subsets in Drug Abusers with Opportunistic Infections," *Clinical Immunology and Immunopathology*, vol. 25, No. 3, pp. 417-423 (Dec. 1982).

Henttu, Pirkko, et al., "cDNA Coding for the Entire Human Prostate Specific Antigen Shows High Homologies to the Human Tissue Kallikrein Genes," *Biochemical and Biophysical Research Communications*, vol. 160, No. 2, pp. 903-910 (Apr. 28, 1989).

Brichard, Vincent, et al., "The Tyrosinase Gene Codes for an Antigen Recognized by Autologous Cytolytic T Lymphocytes on HLA-A2 Melanomas," *The Journal of Experimental Medicine*, vol. 178, pp. 489-495 (Aug. 1993).

Real, Francisco X., et al., Class I (Unique) Tumor Antigens of Human Melanoma, *Journal of Experimental Medicine*, vol. 160, pp. 1219-1233 (Oct. 1984).

Barnd, Donna L., et al., "Specific Major Histocompatibility Complex-Unrestricted Recognition of Tumor-Associated Mucins by Human Cytotoxic T Cells," *Proceedings of the National Academy of Science*, vol. 86, pp. 7159-7163 (Sep. 1989).

MacDonald, H. Robson, et al., "CD8$^-$ T Cells Respond Clonally to Mls-1$^a$-Encoded Determinants," *The Journal of Experimental Medicine*, vol. 171, pp. 1381-1386 (Apr. 1990).

Osborne, C. Kent, et al., "Epidermal Growth Factor Stimulation of Human Breast Cancer cells in Culture," *Cancer Research*, vol. 40, pp. 2361-2366 (Jul. 1980).

Gorski, Jack, et al., "Translational Control of Protein synthesis and the Control of Steroidogenesis in the Rabbit Ovary," *Archives of Biochemistry and Biophysics*, vol. 113, pp. 100-106 (1966).

Misrahi, Micheline, et al., 'Complete Amino Acid Sequence of the Human Progesterone Receptor Deduced from Cloned cDNA: *Biochemical and Biophysical Research Communications*, vol. 143, No. 2, pp. 740-748 (Mar. 13, 1987).

Shew, Jin-Yuh, et al., "C-Terrninal Truncation of the Retinoblastoma Gene Product Leads to Functional Inactivation," *Proceedings of the National Academy of Science*, vol. 87, pp. 6-10 (Jan. 1990).

Dalla-Favera, Riccardo, et al., "Human *c-myc onc* Gene is Located on the Region of Chromosome 8 that is Translocated in Burkitt Lymphoma Cells," *Proceedings of the National Academy of Science*, vol. 79, pp. 7824-7827 (Dec. 1982).

Parada, Luis F., et al., "Human EJ Bladder Carcinoma Oncogene is Homologue of Harvey Sarcoma Virus *Ras* Gene," *Nature*, vol. 297, No. 10, pp. 474-478 (Jun. 1982).

Schlichtholz, Beata, et al., "The Immune Response to p53 in Breast Cancer Patients is Directed Against Immunodominant Epitopes Unrelated to the Mutational Hot Spot," *Cancer Research*, vol. 52, pp. 6380-6384 (Nov. 15, 1992).

Van Der Bruggen, P., et al., A Gene Encoding an Antigen Recognized by Cytolytic T Lymphocytes on a Human Melanoma, *Science*, vol. 254, No. 5038, pp. 1643-1647 (Dec. 13, 1991).

Gaugler, Béatrice, et al., "Human Gene MAGE-3 Codes for an Antigen Recognized on a Melanoma by Autologous Cytolytic T Lymphocytes," *Journal of Experimental Medicine*, vol. 179, pp. 921-930 (Mar. 1994).

Zuckerkandl, Emile "Junk DNA and Sectorial Gene Repression," *Gene*, vol. 207, pp. 323-343 (1997).

Makalowski, Wojciech, "The Human Genome Structure and Organization," *Acta Biochemica Polonica*, vol. 48, No. 3, pp. 587-598 (2001).

Elder, John F., Jr., et al., "Concerted Evolution of Repetitive DNA Sequences in Eukaryotes," *The Ouarterly Review of Biology*, vol. 70, No. 3, pp. 297-320 (Sep. 1995).

Bros, Matthias, et al., "The Human Fascin Gene Promoter is Highly Active in Mature Dendritic Cells Due to a Stage-Specific Enhancer," *The Journal of Immunology*, vol. 171, No. 4, pp. 1825-1834 (Aug. 15 2003).

Laus, Reiner, et al., "Enhanced Major Histocompatibility Complex Class I-Dependant Presentation of Antigens Modified with Cationic and Fusogenic Peptides," *Nature Biotechnology*, vol. 18, pp. 1269-1272 (Dec. 2000).

Accession No. NM_000758, "*Homo sapiens* Colony Stimulating Factor 2 (Granulocyte-Macrophage) (CSF2), mRNA," *NCBI Entrez Nucleotide*, (Oct. 26, 2004).

Accession No. AX268288, "Sequence 9 from Patent WO 0174855," *NCBI Entrez Nucleotide*, (Oct. 29, 2004).

Accession No. U00620, "Rattus Norvegicus Granulocyte-Macrophage Colony Stimulating Factor," *NCBI Entrez Nucleotide*, (May 25, 1994).

Accession No. NM_001099, "*Homo sapiens* Acid Phosphatase, Prostate (ACPP), mRNA," *NCBI Entrez Nucleotide*, (Oct. 26, 2004).

Accession No. NM_000104. "*Homo sapiens* Cytochrome P450, Family 1, Subfamily B, Polypeptide 1 (CYP1B1), mRNA," *NCBI Entrez Nucleotide*, (Oct. 26, 2004).

Accession No. AF006265, "*Homo sapiens* Cancer Associated Surface Antigen (RCAS1) mRNA Complete CDs," *NCBI Entrez Nucleotide*, (Jan. 11, 2000).

Accession No. AY192728, "*Homo sapiens* Breast Cancer-Associated Protein SGA-1M mRNA Complete CDs," *NCBI Entrez Nucleotide*, (Jan. 1, 2004).

Accession No. NM_000378, "*Homo sapiens* Wilms Tumor 1 (WT1), Transcript Variant A. mRNA" *NCBI Entrez Nucleotide*, (Oct. 28. 2004).

Accession No. AF077350, "*Homo sapiens* Inhibitor of Apoptosis Homolog mRNA Complete CDs," *NCBI Entrez Nucleotide*, (Dec. 14, 2000).

Accession No. AF043498, "*Homo sapiens* Prostate Stem Cell Antigen (PSCA) mRNA Complete CDs," *NCBI Entrez Nucleotide*, (Feb. 28. 1998).

Accession No. AY1809247, "*Homo sapiens* BASE mRNA Complete CDs," *NCBI Entrez Nucleotide*, (Feb. 4, 2003).

Accession No. U49070, "Human Peptidyl-Prolyl Isomerase and Essential Mitotic Regulator (PINI) mRNA Complete CDs;" *NCBI Entrez Nucleotide*, (May 25, 1996).

Accession No. AF213459, "*Homo sapiens* Ephrin Receptor EPHA3 Complete Form (EPHA3) mRNA Complete CDs," *NCBI Entrez Nucleotide*, (Mar. 23, 2001).

Accession No. U65011, "Human Preferentially Expressed Antigen of Melanoma (PRAME), mRNA," *NCBI Entrez Nucleotide*, (Mar. 21, 1997).

Accession No. AF125525, "*Homo sapiens* MUC1/Y Mucin Precursor (MUC1), mRNA," *NCBI Entrez Nucleotide*, (Feb. 1, 2002).

Accession No. NM_001134, "*Homo sapiens* Alpha-Fetoprotein (AFP) mRNA," *NCBI Entrez Nucleotide*, (Oct. 26, 2004).

Accession No. M14758, "*Homo sapiens* P-giycoprotein; drug resistance protein; transport protein," *NCBI Entrez Nucleotide*, (Dec. 3, 1999).

Acession No. M14695, "Human P53 Cellular Tumor Antigen mRNA, Complete CDs;" *NCBI Entrez Nucleotide*, (Jan. 14, 1995).

Accesson No. M26663, "*Homo sapiens* Prostate-Specific Antigen mRNA, Complete CDs," *NCBI Entrez Nucleotide*, (Jan. 4, 1995).

Accession No. NM_004476, "*Homo sapiens* Folate Hydrolase (Prostate-Specific Membrane Antigen) 1 (FOLH1) mRNA," *NCBI Entrez Nucleotide*, (Oct. 28, 2004).

Accession No. M17303, "Human carcinoembryonic Antigen Gene, Complete CDs," *NCBI Entrez Nucleotide*, (Aug. 8, 1995).

Accession No. NM_001216, "*Homo sapiens* Carbonic Anhydrase IX (CA9) mRNA," *NCBI Entrez Nucleotide*, (Oct. 26, 2004).

Accession No. X53605, "Human mRNA for Prostatic Acid Phosphatase," *NCBI Entrez Nucleotide*, (Mar. 23, 2001).

Accession No. M34840, "Human Prostatic Acid Phosphatase mRNA, Complete CDs" *NCBI Entrez Nucleotide*, (Jul. 11, 1995).

Accession No. NM_024080, "*Homo sapiens* Transient Receptor Potential Cation Channel, Subfamily M. Member 8 (TRPM8), mRNA," *NCBI Entrez Nucleotide*, (Oct. 27, 2004).

Accession No. NM_009354, "Mus Musculus Telomerase Reverse Transcriptase (TERT), mRNA," *NCBI Entrez Nucleotide*, (Oct. 28. 2004).

Accession No. NM_003219, "*Homo sapiens* Telomerase Reverse Transcriptase (TERT), Transcript Variant 1, mRNA," *NCBI Entrez Nucleotide*, (Oct. 26, 2004).

Accession No. M11730, "Human Tyrosine Kinase-Type Receptor (HER2) mRNA, Complete CDs," *NCBI Entrez Nucleotide*, (Sep. 18, 1995).

The International Search Report for PCT/US2004/06979, Search report dated Dec. 28, 2007, 8 pages (2007).

The European Search report for European Application No. 04 749 357.2, search report dated Apr. 7, 2009, 7 pages (2009).

Vidovic, D. et al. "Antitumor vaccination with HER-2-derived recombinant antigens", *International Journal of Cancer*, 102(6):660-664 (2002).

Wang, R-F and Rosenberg, S.A., "Human tumor antigens recognized by T lymphocytes: implications for cancer therapy", *Journal of Leukocyte Biology*, 60(3):296-309 (1996).

* cited by examiner

COMPOSITIONS AND METHODS EMPLOYING ALTERNATIVE READING FRAME POLYPEPTIDES FOR THE TREATMENT OF CANCER AND INFECTIOUS DISEASE

CROSS REFERENCE TO RELATED APPLICATIONS

This application claims priority to U.S. Provisional Patent Application No. 60/453,131, filed Mar. 5, 2003.

REFERENCE TO SEQUENCE LISTING SUBMITTED AS AN ELECTRONIC TEXT FILE

A "Substitute Sequence Listing" has been submitted with this application in the form of a text file, created 28 Sep. 2008, and named "57636-8128 US00 SEQ LIST 738.txt" (832,412 bytes), the contents of which are incorporated herein by reference in their entirety.

BACKGROUND OF THE INVENTION

1. Technical Field of the Invention

The present invention relates, generally, to compositions and methods for the treatment of cancer and infectious disease. More specifically, this invention provides alternative reading frame (ARF) polypeptides, conjugates, and fusion proteins; polynucleotides encoding (ARF) polypeptides, conjugates, and fusion proteins; and antigen presenting cell (APC) and dendritic cell (DC) based compositions and methods that employ ARF polypeptides and polynucleotides which compositions and methods are useful in the treatment of cancer and infectious disease.

2. Description of the Related Art

The central dogma of molecular biology provides that genomic DNA is transcribed into mRNA and mRNA is translated into protein. According to recent estimates, the human genome encodes approximately 30,000 to 100,000 mRNAs that are translated into proteins that, in total, comprise the proteome. Harrison et al., *Nucl. Acids Res.* 30:1083-1090 (2002).

The mechanism by which eukaryotic mRNA is translated into protein is well established. Through the process of ribosome-scanning, a 43S pre-initiation ribosomal complex assembles on the 5' mRNA CAP and migrates in a 5' to 3' direction along the 5' untranslated region (UTR) in an ATP-dependent process. When the 43S complex encounters an initiator AUG codon within the proper context (normally the first AUG 50 to 100 nucleotides downstream of the CAP), it pauses for a time sufficient to permit the association of the 60S ribosomal subunit to create the ribosomal initiation complex that commences translation in the normal, rf0, open reading frame. See, Kozak, *J. Cell Biol.* 108:229-241 (1989); for a review, see also, Gray et al., *Annu. Rev. Cell Dev. Biol.* 14:399-458 (1998).

The ribosomal machinery of a eukaryotic cell can produce errors in translating mRNA that result in aberrant translation products such as alternative reading frame (ARF) polypeptides. ARF polypeptides are translational products encoded in reading frames rf1 and rf2 that are shifted by one or two nucleotides, respectively, from the normal rf0 reading frame. Because their expression is low, ARF polypeptides are biologically invisible to the cell; however, due to the exquisite sensitivity of the cytotoxic T-cell (CTL) response, ARF polypeptides may be immunogenic at very low copy numbers.

ARF polypeptides are produced entropically due to errors inherent in protein synthesis. Yewdell et al., *J. Immunol.* 157: 1823-1826 (1996). Mechanisms by which translational errors produce ARF polypeptides include: (1) initiation of translation in the 5' UTR (Uenaka et al., *J. Exp. Med.* 180:1599-1607 (1994)); (2) frame-shifting of the initiation complex at the normal rf0 AUG codon one base (rf1) or two bases (rf2) forward or one base (rf2) or two bases (rf1) backward; (3) scan-through the normal rf0 AUG codon and formation of an initiation complex at a downstream codon (Bullock et al., *J. Exp. Med.* 186:1051-1058 (1997)); (4) formation of an initiation complex at an internal ribosome entry site (IRES) located 3' to the site of normal cap-dependent ribosomal entry (Nanbru et al., *J. Biol. Chem.* 272:32061-32066 (1997); (5) frame shifting of the ribosome through random and programmed frameshifts from rf0 to rf1 or rf2 reading frames (Elliott et al., *Eur. J. Immunol.* 26:1175-1179 (1996); Rom et al., *Proc. Natl. Acad. Sci.* 91:3959-3963 (1994); Farabaugh, *Annu. Rev. Genet* 30:507-528 (1996)); (6) formation of initiation complexes at rf1 or rf2 codons other than AUG, such as, for example, ACG or CTG (Shastri et al., *J. Biol. Chem.* 270:1088-1091 (1995); Malarkannan et al., *Immunity* 10:681-690 (1999); and Ronsin et al., *J. Immunol.* 163:483-490 (1999)); (7) ribosomal skipping of mRNA segments (Herr et al., *Annu. Rev. Biochem.* 69:343-372 (2000)); (8) ribosomal suppression of termination codons and subsequent translational readthrough (Bullock et al., *J. Exp. Med.* 186: 1051-1058 (1997)); and (9) synthesis of ARF polypeptides in reading frames 3, 4, and 5 (i.e. rf3, rf4, and rf5) resulting from the translation of antisense strands of genes that are expressed through transcription from cryptic promoters (Van den Eynde et al., *J. Exp. Med.* 190:1793-1799 (1999)).

Upon translation, ARF polypeptides are likely to act as substrates for the ATP-dependent TAP transporters, to be translocated into the lumen of the ER, and to be loaded onto major histocompatibility complex (MHC) class I molecules bound for the cell surface of the antigen presenting cell (APC). The ARF polypeptide is presented within the context of an MHC class I molecule to naïve $CD8^+$ cytotoxic T-cells (CTL). This stimulates the clonal expansion of ARF-specific CTL capable of identifying and eliminating cells expressing the ARF polypeptide. For a review, see Rock et al., *Annu. Rev. Immunol.* 17:739-779 (1999).

The 5' UTR of many human genes helps to regulate translational initiation of the structural gene. Alternative 5' UTR initiation codons is one mechanism by which translation initiation is regulated. The 5' UTR of human genes is a likely rich source of Arf peptides due to this regulatory mechanism. For example, JunD mRNA, which translates in a cap-dependent manner, initiates at two in-frame AUGs, yielding a 39 and 34 kDa protein. JunD mRNA encodes an out-of-frame AUG that directs translation of a short Arf peptide as well as three non-AUG codons also able to support translational initiation, in frame ACG and CUG codons down stream of the rf0 AUG, and an out-of-frame CUG found in the 5' UTR that should generate an Arf peptide. Short et al., *J. Biol. Chem.* 277: 32697-705 (2002). These codons function to cumulatively suppress 34 kDa translation. The 5' UTR of eIF4GI mRNA contains an out-of-frame AUG that acts to regulate expression of eIF4GI and produce an Arf peptide. Byrd et. al., *Mol. Cell. Biol.* 22:4499-511 (2002).

Other mechanisms can account for Arf production in human genes. For example, C- and L-Myc (Joplin et. al., *RNA* 10:287-98 (2004) and Cencig et. al., *Oncogene* 23:267-77 (2004)) angiotensin II type 1 receptor (Martin et. al., *Mol. Cell. Endocrinol.* 30:51-61 (2003)); and HSP70 (Rubtsova et. al., (2003)) initiate translation via 5'-UTR IRES sequences in a cap-independent manner. Alternative splicing in the 5' UTR will also give rise to novel peptides.

Tumor infiltrating lymphocyte (TIL)-derived ARF-specific CD8+ CTLs have been identified in melanoma and renal cell carcinoma patients. Wang et al. *J. Exp. Med.* 183:1131-1140 (1996); Moreau-Aubry et al. *J. Exp. Med.* 191:1617-1623 (2000); Rosin et al. *J. Immunol.* 163:483-490 (1999); and Probst-Kepper et al. *J. Exp. Med.* 193:1189-1198 (2001). Only a small number of tumor antigens have been identified by TIL-derived CTLs; however, a substantial number of those identified arise from ARF polypeptides. Rosenberg, *Immunology Today* 18:175-182 (1997). For example, an ARF polypeptide has been identified using a lymphocyte clone from a patient exhibiting complete regression of melanoma metastases. Rosenberg et al. *J. Immunol.* 168a:2402-2407 (2002).

While the existence of alternative reading frame polypeptides has been described, it has not been appreciated that ARF polypeptides may be employed in compositions and methods for stimulating a protective immune response specific for cancer and/or infectious disease antigens.

SUMMARY OF THE INVENTION

The present invention addresses these and other related needs by providing alternative reading frame (ARF) polypeptides, conjugates, and fusion proteins and polynucleotides encoding (ARF) polypeptides and fusion proteins. Also provided are DNA- and RNA-based vector systems as well as APC/DC-based systems for the in vivo delivery of ARF polynucleotides and polypeptides, respectively. Thus, for example, the present invention provides compositions comprising antigen presenting cells APCs or DCs that are primed ex vivo with one or more of the ARF polypeptides, conjugates, and/or fusion proteins and/or one or more polynucleotide encoding one or more ARF polypeptide and/or fusion protein of the present invention. Still further provided are methods for identifying and preparing ARF polypeptides, conjugates, and fusion proteins, as well as the corresponding in vivo delivery systems, that are effective in eliciting an immune response against cancer cells and organisms that cause infectious disease which cancer cells or organisms express an antigen from which the ARF polypeptide is derived.

ARF polypeptides, conjugates, and fusion proteins and APCs primed with ARF polypeptides, conjugates, and fusion proteins may be employed in methods for eliciting immune responses, including, but not limited to, CD8+ cytotoxic T-cell responses, against and for treating disease associated with cells and/or organisms that express the ARF polypeptide and in methods for treating disease associated with the expression of an antigen from which the ARF polypeptide is derived.

Thus, within certain embodiments, the present invention provides ARF polypeptides wherein the ARF polypeptides are expressed in a cancer cell at a level higher than they are expressed in normal cells of the same tissue type. Within preferred embodiments, the ARF is expressed in a cancer cell in a patient afflicted with a cancer such as, for example, a soft tissue sarcoma, a lymphoma, and/or a cancer of the brain, esophagus, uterus, cervix, bone, lung, endometrium, bladder, breast, larynx, colon/rectum, stomach, ovary, pancreas, adrenal gland and prostate. ARF polypeptides may be expressed in other cancer cells as well.

Within other embodiments are provided ARF polypeptides wherein the ARF polypeptides are encoded by an mRNA that is expressed by an organism that is the causative agent of an infectious disease. Exemplary infectious disease organisms include, but are not limited to, viruses such as human immunodeficiency virus (HIV), a herpes virus, and an influenza virus; parasites such as *Leishmania*; and bacteria such as *Mycobacteria, Chlamydia*, and *Ehrlichia*.

According to these embodiments, ARF polypeptides include polypeptides that result from ribosomal shifting at the initiation codon and polypeptides that result from initiation of mRNA at AUG codons, other than the normal AUG codon, in the rf1 and/or rf2 reading frames.

Within still further embodiments, the present invention provides isolated alternative reading frame (ARF) polypeptides comprising at least 9 amino acids wherein the ARF polypeptides are capable of eliciting an immune response and wherein the ARF polypeptides correspond to polypeptides generated by an in vivo translational error including, but not limited to: (a) synthesis of polypeptides in reading frames rf1 and rf2 generated through AUG translation initiation of open reading frames in 5' and 3' untranslated regions (UTRs); (b) frame-shifting of the initiation complex at the normal rf0 AUG codon one base (rf1) or two bases (rf2) forward or one base (rf2) or two bases (rf1) backward; (c) formation of an initiation complex at an AUG codon that is downstream (i.e. 3' to) the normal initiation AUG codon; (d) formation of an initiation complex at an internal ribosome entry site (IRES) located 3' to the site of normal cap-dependent ribosomal entry; (e) frame shifting of the ribosome through random and programmed frame-shifts from rf0 to rf1 or rf2 reading frames; (f) formation of initiation complexes at rf1 or rf2 codons other than AUG, such as, for example, ACG or CTG; (g) ribosomal skipping of mRNA segments; (h) ribosomal suppression of termination codons and subsequent translational readthrough; (i) synthesis of polypeptides in reading frames rf0, rf1, and rf2 generated through AUG translation initiation of open reading frames (ORFs) in junk DNA; (j) synthesis of polypeptides in reading frames 3, 4, and 5 (i.e. rf3, rf4, and rf5) resulting from the translation of antisense strands of genes that are expressed through transcription from cryptic promoters; and (k) alternative mRNA splice variants wherein an intron encoded polypeptide reads into exon reading frames rf1 or rf2 of a normal gene product.

The immune response elicited by ARF polypeptides of the present invention is most commonly, but not necessarily, a CD8+ cytotoxic T-cell (CTL) response.

Exemplary preferred ARF polypeptides may be derived from polynucleotides encoding human tyrosine kinase receptor (hHER-2; SEQ ID NO: 2; Genbank Accession No. M11730); human telomerase reverse transcriptase (hTERT; SEQ ID NO: 4; Genbank Accession No. NM_003219); mouse telomerase reverse transcriptase (mTERT; SEQ ID NO: 6); Genbank Accession No. NM_009354); human transient receptor potential cation channel 8 (hTrpP8; SEQ ID NO: 8; Genbank Accession No. NM 024080); one or more human prostatic acid phosphatase variant (hPAP; SEQ ID NOs: 10 and 12; Genbank Accession Nos. M34840 and X53605, respectively); human carbonic anhydrase IX (hCA9; SEQ ID NO: 295; Genbank Accession No. NM_001216); human carcinoembryonic antigen (hCEA; SEQ ID NO: 302; Genbank Accession No. M17303); human prostate-specific membrane antigen (hPSMA; SEQ ID NO: 345; Genbank Accession No. NM_004467); human prostate-specific antigen (hPSA); SEQ ID NO: 369; Genbank Accession No. M26663); human p53 cellular tumor antigen (hp53; SEQ ID NO: 381; Genbank Accession No. M14695); human P-glycoprotein (hPGY1; SEQ ID NO: 392; Genbank Accession No. M14758); human alpha-fetoprotein (hAFP; SEQ ID NO: 424; Genbank Accession No. NM_001134);

human mucin precursor (hMUC1; SEQ ID NO: 441; Genbank Accession No. AF125525); human preferentially expressed antigen of melanoma (hPRAME; SEQ ID NO: 452; Genbank Accession No. U65011); human ephrin receptor (hEPHA3; SEQ ID NO: 468; Genbank Accession No. AF213459); human peptidyl-prolyl isomerase and essential mitotic regulator (hPIN1; SEQ ID NO: 496; Genbank Accession No. U49070); human BASE (hBASE; SEQ ID NO: 504; Genbank Accession No. AY180924); human prostate stem cell antigen (hPSCA; SEQ ID NO: 515; Genbank Accession No. AF043498); human SURVIVIN (hSURVIVIN; SEQ ID NO: 549; Genbank Accession No. AF077350); human WTI (hWTI; SEQ ID NO: 557; Genbank Accession No. NM_000378); human SGA-M1 (hSGA-M1; SEQ ID NO: 566; Genbank Accession No. AY192728); human RCAS1 (hRCAS1; SEQ ID NO: 579; Genbank Accession No. AF006265); and human CYP1B1 (hCYP1B1; SEQ ID NO: 592; Genbank Accession No. NM_000104).

Within still further embodiments, the present invention provides alternative reading frame (ARF) polypeptides based upon the 5' untranslated region (UTR) of the tumor associated antigens (TAA) presented herein.

The present invention identifies as particularly useful in this capacity (1) tissue-specific tumor antigens, (2) oncogene product peptide antigens, and (3) viral polypeptide antigens. In the context of the present invention, "tissue-specific tumor antigens" refers to antigens that are common to specific tumor types. By way of contrast, antigens that are specific to a particular individual tumor, such as the B cell lymphoma tumor-associated idiotype antigen, are distinguishable from tissue-specific tumor antigens in that they have a characteristic epitope that varies from individual to individual. Such antigens are less useful in the context of the present invention because immunostimulatory reagents must be tailored to the individual tumor.

Other antigens usefully employed in various aspects of the present invention are those proteins that are expressed on malignant tumors such as those protein antigens that can serve as target antigens for an immune attack. Exemplary such molecules include, but are not limited to, tissue-specific antigens such as MART-1, tyrosinase and GP 100 in melanoma and prostatic acid phosphatase (PAP) and prostate-specific antigen (PSA) in prostate cancer. Other target molecules belong to the group of transformation-related molecules such as the oncogene HER-2/Neu/ErbB-2. Yet another group of target antigens are onco-fetal antigens such as carcinoembryonic antigen (CEA). In B-cell lymphoma the tumor-specific idiotype immunoglobulin constitutes a truly tumor-specific immunoglobulin antigen that is unique to the individual tumor. B-cell differentiation antigens such as CD19, CD20 and CD37 are other candidates for target antigens in B-cell lymphoma. Some of these antigens (CEA, HER-2, CD19, and CD20) have been used as targets for passive immunotherapy with monoclonal antibodies with limited success.

Thus, exemplary tissue-specific tumor antigens include, but are not limited to, peptidyl-prolyl isomerase (associated with a variety of cancers, Wulf et al., *J. Biol. Chem.* 277: 47967 (2002), breast cancer and salivary gland expression (associated with breast cancer, Egland et al., *Proc. Natl. Acad. Sci. U.S.A.* 100:1099 (2003), prostatic acid phosphatase (PAP; associated with prostatic tumors), Melan-A/MART-1 (associated with melanoma; Coulie et al., *J. Exp. Med.* 180:35 (1994); Hawakami et al., *Proc. Natl. Acad. Sci. U.S.A.* 91:3515 (1994), Bakker et al., *J. Exp. Med.* 179:1005 (1994), tyrosinase/albino (associated with melanoma), Kawakami et al., *J. Exp. Med.* 180(1):347-52 (1994), and CD19, CD20 and CD37 (associated with lymphoma).

Within further embodiments are provided ARF polypeptides derived from oncogene product peptide antigens that are common to specific tumor types. These ARF polypeptides will find use in the polypeptide fusion proteins and/or complexes of the present invention, for example, as reagents useful in stimulating T-cell responses specific for tumor cells expressing such ARF polypeptide antigens. Oncogenes suitable for use in the compositions and methods of the present invention include, but are not limited to, HER-2/neu (Beckmann et al., *Eur. J. Cancer* 28:322 (1992)) associated with human breast and gynecological cancers, and carcinoembryonic antigen (CEA) (Gold et al., *J. Exp. Med.* 122:467-481 (1965)) associated with cancer of the pancreas.

Still further aspects of the present invention employ ARF polypeptides derived from tumor markers that are available in the art including, but not limited to, the tissue-specific antigens such as the cytokeratins (Moll et al., *Clin Immunol Immunopathol.* 25(3):417-23 (1982)); prostate-specific antigen (Henttu et al., *Biochem. Biophys. Res. Commun.* 160: 903-910 (1989)); gp75/brown (Brichard et al. *J. Exp. Med.* 178:489 (1993)) associated with melanoma; melanotransferrin (Real et al., *J. Exp. Med.* 160:1219 (1994)); MUC1 (Barnd, *Proc. Natl. Acad. Sci. U.S.A.* 86:7159 (1989) and Vijayasaradhi et al., *J. Exp. Med.* 171:1375 (1990)) associated with pancrease and breast cancer; oncogene/tumor suppressor genes that include EGF-R (Osborne et al., *Cancer Res.* 40(7):2361-6 (1980)), estrogen receptor (Gorski et al., *Arch. Biochem. Biophys.* 113(1):100-6. (1966)), progesterone receptor (Misrahi et al., *Biochem. Biophys. Res. Commun.* 143:740-748 (1987)), retinoblastoma gene product (Shew et al., *Proc. Natl. Acad. Sci.* 87:6-10 (1990)), myc (Dalla-Favera et al., *Proc. Natl. Acad. Sci. U.S.A.* 79(24): 7824-7 (1982), ras (Parada et al., *Nature* 297(5866):474-8 (1982)), p53, (Schlichtholz, *Cancer Res.* 52:6380 (1992); MAGE-1,3 (van der Bruggen et al., *Science* 254:1643 (1991) and Gaugler et al., *J. Exp. Med.* 179:921 (1994); and viral antigens including human papilloma virus (HPV), HIV-gp 120, gp41, GAG, RT, NEF, VIF, Influenza HA, and EBV.

Alternative embodiments of the present invention provide compositions and methods that employ ARF polypeptides derived from viral antigens. Such antigens include, but are not limited to, the HIV antigens gp120, gp41, gag, RT, NEF, VIF; the influenza antigens HA, core and matrix; and the EBV antigens EBNA, BFLF1, BOLF1, BGLF2, LMP2a, LMP2b, BBRF1, BBRF2, and P11L27.

Within certain embodiments, ARF polypeptides are at least 9 amino acids in length. Other embodiments provide ARF polypeptides that are at least 10, 11, 12, 13, 14, or 15 amino acids in length. Still other embodiments provide ARF polypeptides that are at least 16, 17, 18, 19, or 20 amino acids in length. Further embodiments provide ARF polypeptides that are at least 25, 30, 35, 40, 45, or 50 amino acids in length or that are at least 75, 100, 150, or 200 amino acids in length.

ARF polypeptides derived from a polynucleotide encoding hHER-2, SEQ ID NO: 2, are presented herein as SEQ ID NOs: 15-32. ARF polypeptides derived from a polynucleotide encoding hTERT, SEQ ID NO: 4, are presented herein as SEQ ID NOs: 195-202. ARF polypeptides derived from a polynucleotide encoding mTERT, SEQ ID NO: 6, are presented herein as SEQ ID NOs: 96-111. ARF polypeptides derived from a polynucleotide encoding hTrpP8, SEQ ID NO: 8, are presented as SEQ ID NOs: 203-219. ARF polypeptides derived from a polynucleotide encoding a hPAP variant, SEQ ID NO: 10, are presented herein as SEQ ID NOs: 248-256 and from a polynucleotide encoding an alternative hPAP variant, SEQ ID NO: 12, are presented herein as SEQ ID NOs: 280-289. ARF polypeptides derived from a polynucleotide encoding hCA9, SEQ ID NO: 295, are presented herein as SEQ ID NOs: 296-300. ARF polypeptides derived from a polynucleotide encoding hCEA, SEQ ID NO: 302, are presented herein as SEQ ID NOs: 303-319. ARF polypeptides derived from a polynucleotide encoding hPSMA, SEQ ID NO: 345, are presented herein as SEQ ID NOs: 350-367. ARF polypeptides derived from a polynucleotide encoding hPSA, SEQ ID NO: 369, are presented herein as SEQ ID NOs: 374-379. ARF polypeptides derived from a polynucleotide encoding hp53, SEQ ID NO: 381, are presented herein as SEQ ID NOs: 386-390. ARF polypeptides derived from a polynucleotide encoding hPGY1, SEQ ID NO: 392, are presented herein as SEQ ID NOs: 397-422. ARF polypeptides derived from a polynucleotide encoding hAFP, SEQ ID NO: 424, are presented herein as SEQ ID NOs: 429-439. ARF polypeptides derived from a polynucleotide encoding hMUC1, SEQ ID NO: 441, are presented herein as SEQ ID NOs: 446-450. ARF polypeptides derived from a polynucleotide encoding hPRAME, SEQ ID NO: 452, are presented herein as SEQ ID NOs: 457-466. ARF polypeptides derived from a polynucleotide encoding hEPHA3, SEQ ID NO: 468, are presented herein as SEQ ID NOs: 473-494. ARF polypeptides derived from a polynucleotide encoding hPIN1, SEQ ID NO: 496, a represented herein as SEQ ID NOs: 501-502. ARF polypeptides derived from a polynucleotide encoding hBASE, SEQ ID NO: 504, are presented herein as SEQ ID NOs: 509-513. ARF polypeptides derived from a polynucleotide encoding hPSCA, SEQ ID NO: 515, are presented herein as SEQ ID NOs: 520-521. ARF polypeptides derived from a polynucleotide encoding hSURVIVIN, SEQ ID NO: 549, are presented herein as SEQ ID NOs: 551-553 and 555. ARF polypeptides derived from a polynucleotide encoding hWTI, SEQ ID NO: 557, are presented as SEQ ID NOs: 559-562 and 564. ARF polypeptides derived from a polynucleotide encoding hSGA-M1, SEQ ID NO: 566, are presented herein as SEQ ID NOs: 568-575 and 577. ARF polypeptides derived from a polynucleotide encoding hRCAS1, SEQ ID NO: 579, are presented as SEQ ID NOs: 581-588 and 590. ARF polypeptides derived from a polynucleotide encoding hCYP1B1, SEQ ID NO: 592, are presented herein as SEQ ID NOs: 594-599.

Equally preferred are functional fragments, derivatives and variants of any of the ARF polypeptides presented in SEQ ID NOs: 15-32, 96-111, 195-202, 213-219, 248-256, 280-289, 296-300, 303-319, 350-367, 374-379, 386-390, 397-422, 429-439, 446-450, 457-466, 473-494, 501-502, 509-513, 520-521, 551-553 and 555, 559-562 and 564, 568-575 and 577, 581-588 and 590, and 594-599. Functional variants of any of these ARF polypeptides preferably exhibit at least about 70%, more preferably at least about 80% or 90% and most preferably at least about 95% or 98% sequence identity to the ARF polypeptides presented in SEQ ID NOs: 15-32, 96-111, 195-202, 213-219, 248-256, 280-289, 296-300, 303-319, 350-367, 374-379, 386-390, 397-422, 429-439, 446-450, 457-466, 473-494, 501-502, 509-513, 520-521, 551-553 and 555, 559-562 and 564, 568-575 and 577, 581-588 and 590, and 594-599.

Exemplary preferred functional fragments include the ARF polypeptide fragments of hHER-2, SEQ ID NOs: 15-32, presented herein as SEQ ID NOs: 33-95; the ARF polypeptide fragments of mTERT, SEQ ID NOs: 96-111, presented herein as SEQ ID NOs: 112-194; the ARF polypeptide fragments of hTrpP8, SEQ ID NOs: 203-219, presented as SEQ ID NOs: 220-247; and the ARF polypeptide fragments of a hPAP variant, SEQ ID NOs: 248-256, presented herein as SEQ ID NOs: 257-279.

Within other aspects, the present invention also provides polypeptides and functional fragments, derivatives, and variants thereof as well as polynucleotides encoding polypeptides and functional fragments, derivatives, and variants thereof wherein the polypeptides are derived from an amino acid sequence of the full-length sequence of hCA9 rf1 and rf2, hCEA rf1 and rf2, hHER2 rf1 and rf2, hPAP rf1 and rf2, hTERT rf1 and rf2, hTrpP8 rf1 and rf2, hPSMA rf1 and rf2, hPSA rf1 and rf2, hp53 rf1 and rf2, hPGY1 rf1 and rf2, hAFP rf1 and rf2, hMUC1 rf1 and rf2, hPRAME rf1 and rf2, hEPHA3 rf1 and rf2, hPIN1 rf1 and rf2, hBASE rf1 and rf2, hPSCA rf1 and rf2, hSURVIVIN rf1 and rf2, hSGA-M1 rf1 and rf2, hRCAS1 rf1 and rf2, and hCYP1B1 rf1 and rf2. Within these embodiments, the full-length amino acid sequences are derived by deleting stop codons (TGA, TAA, and TAG) and by deleting residues between stop codons that encode less than 9 consecutive residues.

Exemplary hCA9 rf1 and rf2, hCEA rf1 and rf2, hHER2 rf1 and rf2, hPAP rf1 and rf2, hTERT rf1 and rf2, hTrpP8 rf1 and rf2, hPSMA rf1 and rf2, hPSA rf1 and rf2, hp53 rf1 and rf2, hPGY1 rf1 and rf2, hAFP rf1 and rf2, hMUC1 rf1 and rf2, hPRAME rf1 and rf2, hEPHA3 rf1 and rf2, hPIN1 rf1 and rf2, hBASE rf1 and rf2, hPSCA rf1 and rf2, hSURVIVIN rf1 and rf2, hWTI rf1 and rf2, hSGA-M1 rf1 and rf2, hRCAS1 rf1 and rf2, and hCYP1B1 rf1 and rf2 polypeptides are presented herein as SEQ ID NOs: 320, 322, 324, 326, 328, 330, 332, 334, 336, 338, 340, 342, 346, 348, 370, 372, 382, 384, 393, 395, 425, 427, 442, 444, 453, 455, 469, 471, 497, 499, 505, 507, 516, 518, 554, 556, 562, 564, 575, 577, 588, 590, 599, and 601, respectively and are encoded by the polynucleotides of SEQ ID NOs: 321, 323, 325, 327, 329, 331, 333, 335, 337, 339, 341, 343, 347, 349, 371, 373, 383, 385, 394, 396, 426, 428, 443, 445, 454, 456, 470, 472, 498, 500, 506, 508, 517, 519, 555, 557, 563, 565, 576, 578, 589, 591, 600, and 602 respectively.

Exemplary rf0, rf1, and rf2 5' UTR ARFs for hAFP, hBASE, hCA9, hCEA, hCYP1B1, hEphA3, hHER2, hMDR1, hHER2, hP53, hPRAME, hPSMA, hRCAS1, hSGA-1M, hTERT, hTRP-P8, and hWTI are presented in Table 29 and the corresponding SEQ ID NOs listed therein.

Further aspects of the present invention provide fusion proteins comprising two or more ARF polypeptides as detailed above. Within certain embodiments, fusion proteins comprise two or more ARF polypeptides each comprising at least 9 amino acids. By other embodiments, fusion proteins comprise two or more ARF polypeptides that are each at least 10, 11, 12, 13, 14, or 15 amino acids in length. Still further embodiments provide fusion proteins that comprise two or more ARF polypeptides that are each at least 16, 17, 18, 19, or 20 amino acids in length. Other embodiments provide fusion proteins comprising two or more ARF polypeptides that are each at least 25, 30, 35, 40, 45, or 50 amino acids in length or that are each at least 75, 100, 150, or 200 amino acids in length.

Other aspects of the present invention provide polypeptide conjugates comprising one or more ARF polypeptide or fusion protein in combination with a polypeptide moiety that facilitates the binding of the ARF polypeptide or fusion protein to an antigen presenting cell (APC) or to a dendritic cell (DC). Polypeptide conjugates generally comprise an N-terminal moiety and a C-terminal moiety wherein the N-terminal moiety comprises an ARF polypeptide or fusion protein of at least 9 amino acids in length and wherein the C-terminal moiety comprises at least a portion of an antigen presenting cell binding protein or a dendritic cell binding protein.

Equally suited are ARF polypeptide conjugates wherein the C-terminal moiety comprises an ARF polypeptide or fusion protein of at least 9 amino acids in length and wherein the N-terminal moiety comprises at least a portion of an antigen presenting cell (APC) binding protein or a dendritic cell (DC) binding protein.

Within certain embodiments, ARF polypeptide conjugates comprise one or more ARF polypeptides, or functional fragments thereof, that are each at least 10, 11, 12, 13, 14, or 15 amino acids in length. Other embodiments provide ARF polypeptide conjugates that comprise one or more ARF polypeptides, or functional fragments thereof, that are each at least 16, 17, 18, 19, or 20 amino acids in length. Still further embodiments provide ARF polypeptide conjugates comprising one or more ARF polypeptides, or functional fragments thereof, that are each at least 25, 30, 35, 40, 45, or 50 amino acids in length or that are each at least 75, 100, 150, or 200 amino acids in length.

Also provided are functional fragments, derivatives and variants of any of the fusion proteins or conjugates comprising one or more ARF polypeptides, and functional fragments thereof, presented in SEQ ID NOs: 15-289, 296-300, 303-319, 350-367, 374-379, 386-390, 397-422, 429-439, 446-450, 457-466, 473-494, 501-502, 509-513, 520-521, 551-553 and 555, 559-562 and 564, 568-575 and 577, 581-588 and 590, and 594-599. Functional variants of any of these fusion proteins or conjugates preferably exhibit at least about 70%, more preferably at least about 80% or 90% and most preferably at least about 95% or 98% sequence identity to the ARF polypeptides presented, or functional fragments thereof, in SEQ ID NOs: 15-289, 296-300, 303-319, 350-367, 374-379, 386-390, 397-422, 429-439, 446-450, 457-466, 473-494, 501-502, 509-513, 520-521, 551-553 and 555, 559-562 and 564, 568-575 and 577, 581-588 and 590, and 594-599.

Exemplary antigen presenting cell and dendritic cell binding proteins suitable for the fusion proteins and conjugates of the present invention include GM-CSF, IL-1, TNF, IL-4, CD40L, CTLA4, CD28, and FLT-3 ligand.

Within certain embodiments, the present invention provides immunogenic compositions comprising an antigen presenting cell (APC) that has been primed by ex vivo priming with one or more ARF polypeptide, conjugate and/or fusion protein. APCs primed according to the present invention are effective in activating cytotoxic T-cells to produce a cellular response against the ARF polypeptide, conjugate and/or fusion protein. Specific preferred embodiments provide that the APCs are dendritic cells (DCs).

The present invention is also directed to methods for identifying alternative reading frame (ARF) polypeptides capable of stimulating an immune response, the methods comprising the steps of: (1) selecting an antigen of interest wherein the antigen is encoded by a polynucleotide; (2) identifying, based upon the nucleotide sequence of the polynucleotide, an rf1 and/or rf2 alternative reading frame encoding an alternative reading frame polypeptide; (3) synthesizing or expressing a polypeptide encoded by the rf1 and/or rf2 alternative reading frames; (4) priming a sample comprising an antigen presenting cell (APC) with the synthesized polypeptide; (5) contacting the primed APC with a sample comprising a population of naïve cytotoxic T-cells (CTLs) to produce a population of activated CTLs; and (6) contacting the population of CTLs with a cell expressing the antigen of interest, wherein lysis of the antigen expressing cell by the activated CTLs indicates that the ARF polypeptide is capable of stimulating an immune response. Specific preferred embodiments provide that the APCs are dendritic cells (DCs).

Other related aspects of the present invention provide methods for eliciting an immune response in a patient, the methods comprising the steps of: (1) obtaining a sample containing antigen presenting cells (APCs); (2) isolating from the sample the APCs; (3) priming the APCs ex vivo with an ARF polypeptide, conjugate and/or fusion protein wherein the stimulated APCs are capable of stimulating an immune response in vivo; and (4) administering the primed APCs to the patient. Within preferred embodiments, the immune response is a cytotoxic T-cell response. The cytotoxic T-cell response may be directed specifically against a tumor cell expressing an antigen. Specific preferred embodiments provide that the APCs are dendritic cells (DCs).

Related aspects provide methods for inhibiting proliferation of a tumor cell in a cancer patient the methods comprising the steps of: (1) obtaining from the cancer patient a sample containing antigen presenting cells (APCs); (2) isolating the APCs from the sample; (3) priming the APCs ex vivo with one or more ARF polypeptide, conjugate and/or fusion protein wherein the primed APCs are capable of stimulating an immune response in vivo; and (4) administering the primed APCs to the cancer patient. Within preferred embodiments, the immune response is a cytotoxic T-cell response wherein the cytotoxic T-cell response is directed specifically against a tumor cell expressing an antigen. Specific preferred embodiments provide that the APCs are dendritic cells (DCs).

Within preferred methods, the tumor cell is present in a patient afflicted with a cancer such as, for example, a soft tissue sarcoma, a lymphoma, and/or a cancer of the brain, esophagus, uterus, cervix, bone, lung, endometrium, bladder, breast, larynx, colon/rectum, stomach, ovary, pancreas, adrenal gland and prostate. Tumor cells present in patients afflicted with other cancers as well.

Still further aspects of the present invention provide methods for eliciting an immune response in a patient, the methods comprising the steps of: (a) obtaining from the patient a sample containing antigen presenting cells (APCs); (b) isolating the APCs from said the sample; (c) priming the isolated APCs ex vivo with a vector comprising a polynucleotide encoding an ARF polypeptide and/or fusion protein wherein the primed APCs are capable of stimulating an immune response in vivo; and (d) administering the primed APCs to the patient. By these methods, the vector may be selected from the group consisting of an adenoviral vector, a retroviral vector, and an adeno-associated viral vector.

Related aspects of the present invention provide methods for eliciting an immune response in a patient, the methods comprising the step of administering to the patient an ARF polypeptide, conjugate, and/or fusion protein wherein the ARF polypeptide, conjugate, and/or fusion protein is capable of stimulating an immune response in vivo.

Alternative methods for eliciting an immune response in a patient comprise the step of administering to the patient a vector comprising a polynucleotide encoding an ARF polypeptide and/or fusion protein wherein the ARF polypeptide and/or fusion protein is capable of stimulating an immune response in vivo.

The above-mentioned and additional features of the present invention and the manner of obtaining them will become apparent, and the invention will be best understood by reference to the following more detailed description, read in conjunction with the accompanying drawings. All references disclosed herein are hereby incorporated by reference in their entirety as if each was incorporated individually.

BRIEF DESCRIPTION OF THE DRAWINGS AND SEQUENCE IDENTIFIERS

FIGS. 1A and 1B are graphs depicting the survival of C57BL/6 mice pre-immunized with the indicated ARF polypeptide-pulsed dendritic cells (DC) followed by challenge with hHER-2/EL4 (E.HER2) tumor cells. The graph presented in FIG. 1A depicts the results of an experiment employing 10 mice per group and the graph presented in FIG. 1B depicts the results of an experiment employing 5 mice per group.

FIGS. 2A and 2B are graphs depicting the survival of C57BL/6 mice pre-immunized with the indicated ARF polypeptide-pulsed dendritic cells (DC) followed by challenge with either hHER-2/B16 (B16.HER2) or mPAP/B16 (B16.mPAP) tumor cells. The graph presented in FIG. 2A depicts the results of an experiment employing 5 mice per group and the graph presented in FIG. 2B depicts the results of an experiment employing 10 mice per group.

FIG. 3 is a graph depicting the survival of C57BL/6 mice pre-immunized with the indicated ARF polypeptide-pulsed dendritic cells (DC) followed by challenge with the hHER-2/EL4 (E.HER2) tumor cells. The graph depicts the results of an experiment employing 9-10 mice per group as indicated in the figure legend.

FIGS. 4A and 4B are graphs depicting the survival of C57BL/6 mice pre-immunized with the indicated ARF polypeptide-pulsed dendritic cells (DC) followed by challenge with hHER-2/EL4 (E.HER2) tumor cells. The graph presented in FIG. 4A depicts the results of an experiment employing 10 mice per group and the graph presented in FIG. 4B depicts the results of an experiment employing 5-10 mice per group as indicated in the figure legend.

Figure 7A:
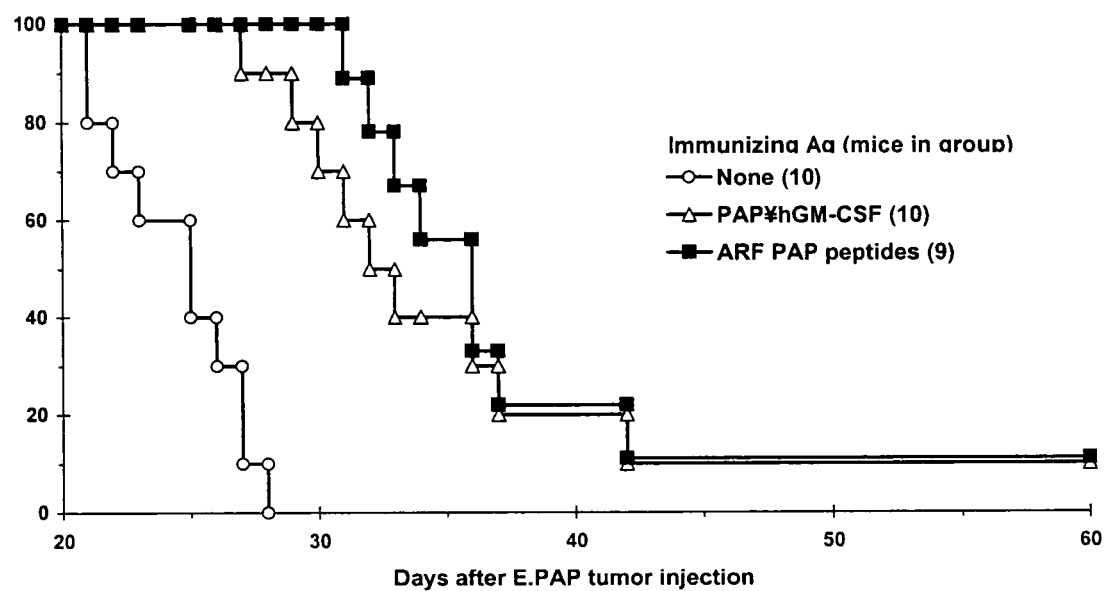
Figure 7B:
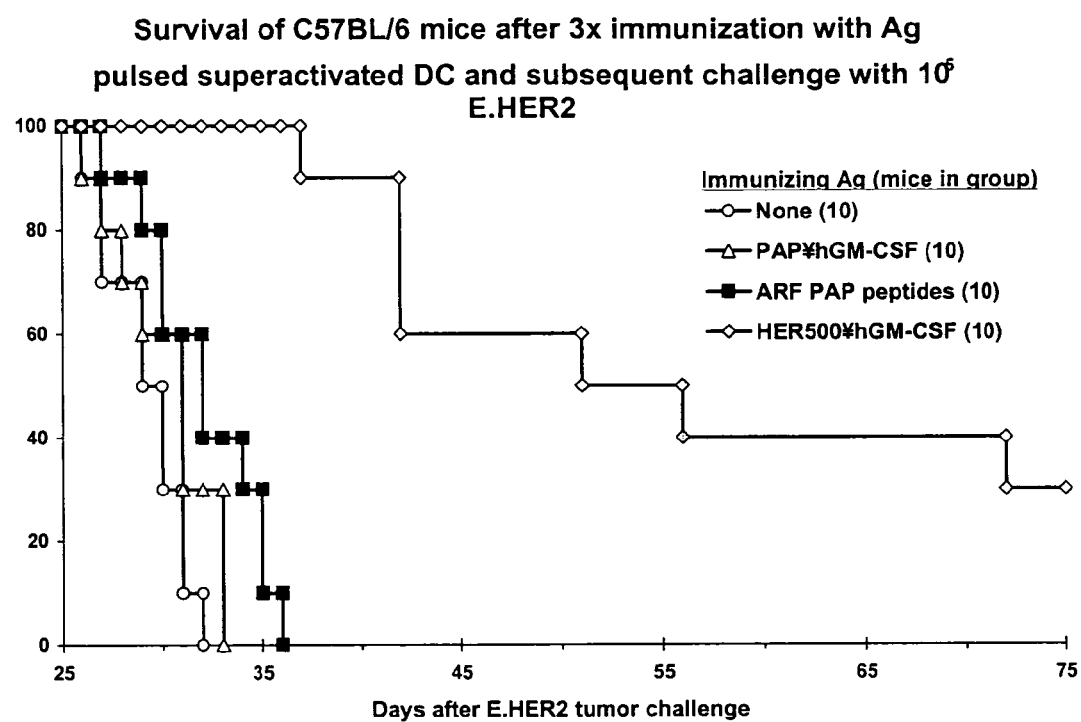

FIGS. 7A and 7B are graphs depicting the survival of mice pre-immunized with the indicated antigen-pulsed dendritic cells followed by tumor challenge with E.PAP (FIG. 7A) and E.HER2 (FIG. 7B). In FIG. 7A, ten mice were immunized with un-pulsed DC (○), 10 mice immunized with PAP•hGM-CSF-pulsed DC (Δ), 9 mice immunized with DC that were pre-pulsed with PAP-derived Arf peptides ((■); Table 1). All animals on this panel were challenged with E.PAP. In FIG. 7B, ten mice immunized with un-pulsed DC (○), 10 mice immunized with PAP•hGM-CSF-pulsed DC (Δ), 10 mice immunized with DC pre-pulsed with PAP-derived Arf peptides (■), 10 mice immunized with HER500•hGM-CSF-pulsed DC (◇). All animals on this panel were challenged with E.HER2.

Figure 8A:
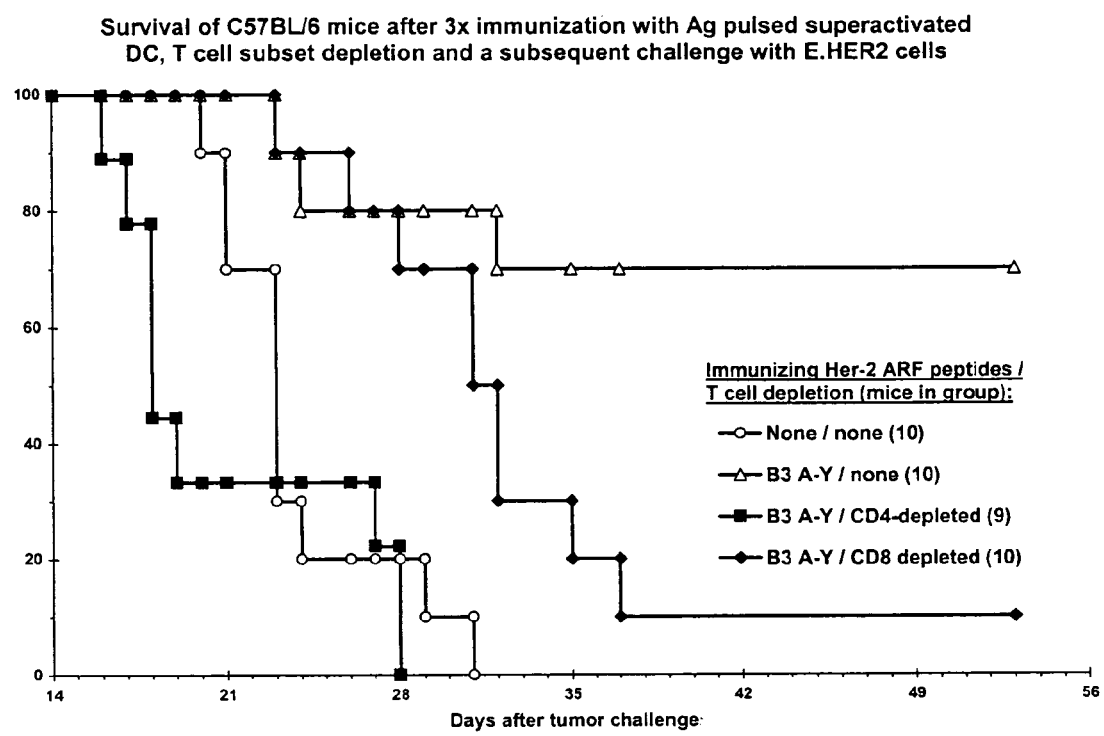

FIG. 8A is a graph depicting survival of T cell depleted mice after immunizations with Ag-pulsed DC and the subsequent challenge with E.HER2. Ten mice immunized with un-pulsed DC (○); 10 mice immunized with HER-2-derived Arf pool B3 peptides (Δ); 9 CD4 T cell-depleted mice immunized with HER-2-derived Arf pool B3 peptides (■); 10 CD8 T cell-depleted mice immunized with HER-2-derived Arf pool B3 peptides (◆).

Figure 8B:
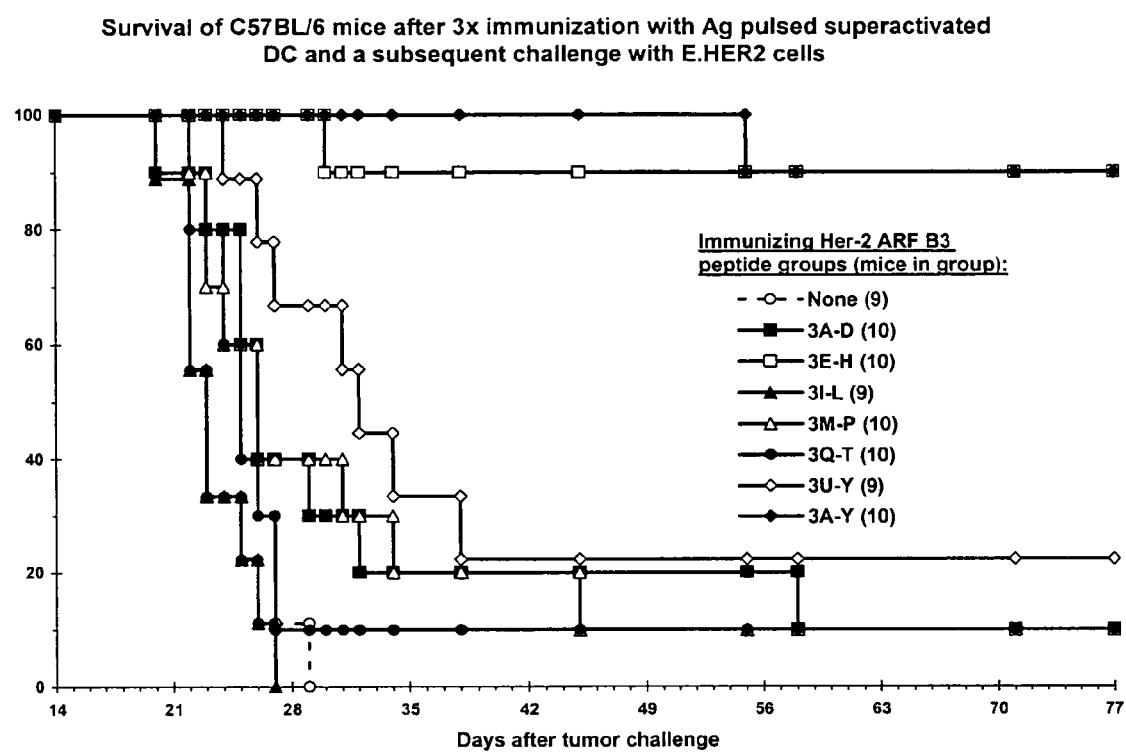

FIG. 8B is a graph depicting survival of mice immunized with subgroups of Arf peptides from HER-2-derived pool B3 and subsequently challenged with E.HER2 tumor. Nine mice immunized with un-pulsed DC (○), 10 mice immunized with DC that were pre-pulsed with the entire pool B3 (◆), 10 mice immunized with DC that were pre-pulsed with 4 peptides 3a-d (■), 10 mice immunized with DC that were pre-pulsed with 4 peptides 3e-h (□), 9 mice immunized with DC that were pre-pulsed with 4 peptides 3i-1 (σ), 10 mice immunized with DC that were pre-pulsed with 4 peptides 3m-p (Δ), 10 mice immunized with DC that were pre-pulsed with 4 peptides 3q-t (λ), 9 mice immunized with DC that were pre-pulsed with 5 peptides 3u-y (✧).

Figure 8C:
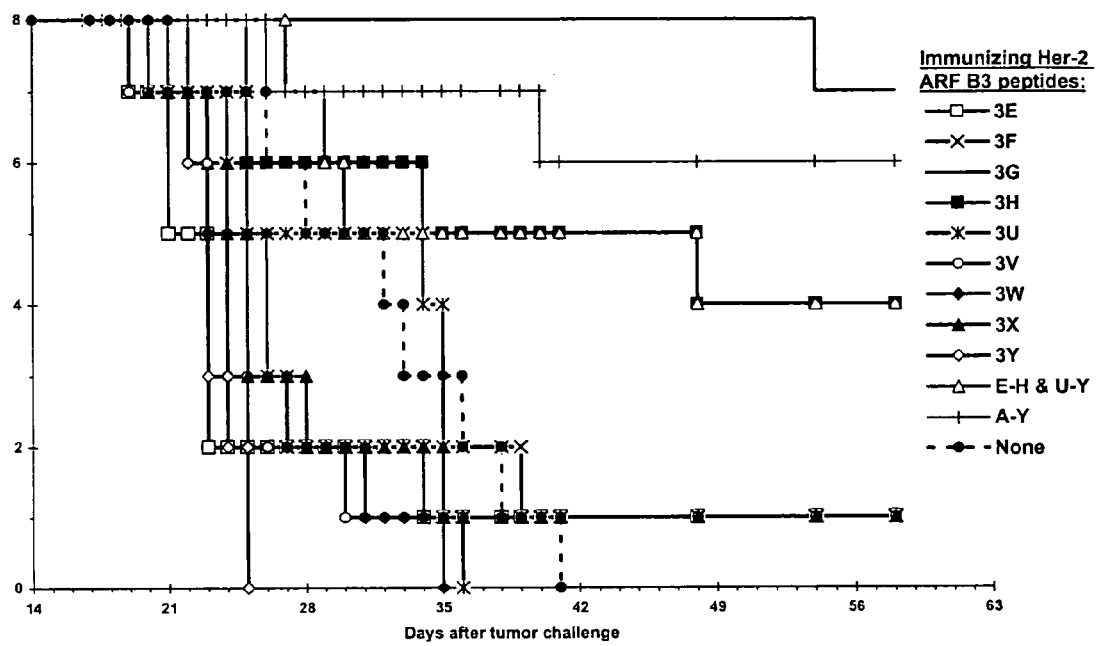

FIG. 8C is a graph depicting survival of mice that were immunized with individual Arf peptides from HER-2-derived pool B3 and subsequently challenged with E.HER2 tumor. Immunizing DC were either un-pulsed (λ), pulsed with the entire HER-2-derived Arf pool B3 (+), or with the individual peptides 3e (□), 3f (x), 3g (–), 3h (■), 3u (ç), 3v (○), 3w (◆), 3x (σ), 3y (✧).

Figure 8D:
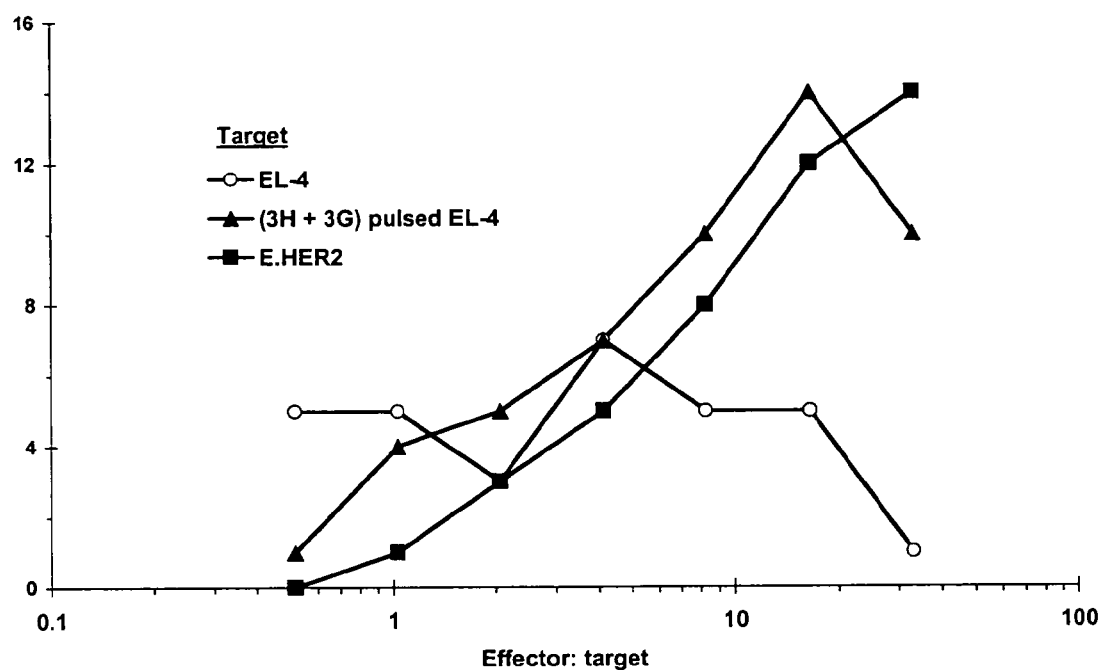

FIG. 8D is a graph depicting polyclonal ex vivo cytolytic responses of CD8+ T cell hybridoma B6-H9.B7 against indicated stimulator cells (EL-4 (✧), 3H+3 G pulsed E L-4 (▲), and E-HER2 (■)) following immunization of C57BL/6 mice with HER-2 derived ARF B3 E-H peptides.

Figure 8E:
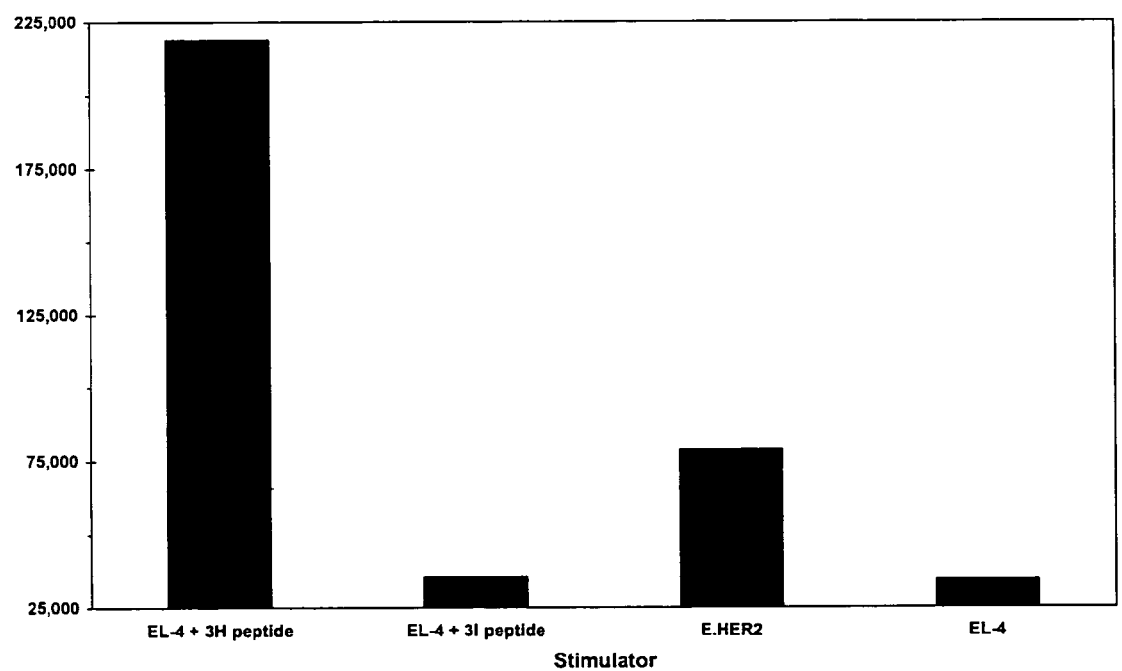

FIG. 8E is a bar graph depicting responses of CD8+ T cell hybridoma B6-H9-B7 against the indicated stimulator cells.

SEQ ID NO: 1 is the amino acid sequence of human tyrosine kinase receptor (hHER-2; Genbank Accession No. M11730).

SEQ ID NO: 2 is the nucleotide sequence of the polynucleotide encoding the amino acid sequence of hHER-2 presented in SEQ ID NO: 1.

SEQ ID NO: 3 is the amino acid sequence of human telomerase reverse transcriptase (hTERT; Genbank Accession No. NM_003219).

SEQ ID NO: 4 is the nucleotide sequence of the polynucleotide encoding the amino acid sequence of hTERT presented in SEQ ID NO: 3.

SEQ ID NO: 5 is the amino acid sequence of mouse telomerase reverse transcriptase (mTERT; Genbank Accession No. NM_009354).

SEQ ID NO: 6 is the nucleotide sequence of the polynucleotide encoding the amino acid sequence of mTERT presented in SEQ ID NO: 5.

SEQ ID NO: 7 is the amino acid sequence of human transient receptor potential cation channel 8 (hTrpP8; Genbank Accession No. NM 024080).

SEQ ID NO: 8 is the nucleotide sequence of the polynucleotide encoding the amino acid sequence of hTrpP8 presented in SEQ ID NO: 7.

SEQ ID NO: 9 is the amino acid sequence of human prostatic acid phosphatase (hPAP; Genbank Accession No. M34840).

SEQ ID NO: 10 is the nucleotide sequence of the polynucleotide encoding the amino acid sequence of hPAP presented in SEQ ID NO: 9.

SEQ ID NO: 11 is the amino acid sequence of human prostatic acid phosphatase (hPAP; Genbank Accession No. X53605).

SEQ ID NO: 12 is the nucleotide sequence of the polynucleotide encoding the amino acid sequence of hPAP presented in SEQ ID NO: 11.

SEQ ID NO: 13 is the nucleotide sequence of HER500-rGM-CSF (Genbank Accession No. AX268288).

SEQ ID NO: 14 is the nucleotide sequence of HER300.

SEQ ID NOs: 15-32 are human HER-2 alternative reading frame polypeptides derived from the polynucleotide sequence presented herein as SEQ ID NO: 2.

SEQ ID NOs: 33-95 are human HER-2 alternative reading frame polypeptides derived based upon the human HER-2 alternative reading frame polypeptides presented herein as SEQ ID NOs: 15-32 (see, Example 2).

SEQ ID NOs: 96-111 are mouse TERT alternative reading frame polypeptides derived from the polynucleotide sequence presented herein as SEQ ID NO: 6.

SEQ ID NOs: 112-194 are mouse TERT alternative reading frame polypeptides derived based upon the mouse TERT alternative reading frame polypeptides presented herein as SEQ ID NOs: 96-111 (see, Example 3).

SEQ ID NOs: 195-202 are human TERT alternative reading frame polypeptides derived from the polynucleotide sequence presented herein as SEQ ID NO: 4.

SEQ ID NOs: 203-219 are human TrpP8 alternative reading frame polypeptides derived from the polynucleotide sequence presented herein as SEQ ID NO: 8.

SEQ ID NOs: 220-247 are human TrpP8 alternative reading frame polypeptides derived based upon the human TrpP8 alternative reading frame polypeptides presented herein as SEQ ID NOs: 203-219 (see, Example 4).

SEQ ID NOs: 248-256 are human PAP alternative reading frame polypeptides derived from the polynucleotide sequence presented herein as SEQ ID NO: 10.

SEQ ID NOs: 257-279 are human PAP alternative reading frame polypeptides derived based upon the human PAP alternative reading frame polypeptides presented herein as SEQ ID NOs: 248-256.

SEQ ID NOs: 280-289 are human PAP alternative reading frame polypeptides derived from the polynucleotide sequence presented herein as SEQ ID NO: 12.

SEQ ID NO: 290 is the nucleotide sequence of a CMV forward primer presented herein in Example 8.

SEQ ID NO: 291 is the nucleotide sequence of a CMV forward primer presented herein in Example 8.

SEQ ID NO: 292 is the nucleotide sequence of a HER-2/neu reverse primer presented herein in Example 8.

SEQ ID NO: 293 is the nucleotide sequence of a HER-2/neu reverse primer presented herein in Example 8.

SEQ ID NO: 294 is the amino acid sequence of human carbonic anhydrase IX (hCA9; Genbank Accession No. NM_001216).

SEQ ID NO: 295 is the nucleotide sequence of the polynucleotide encoding the amino acid sequence of hCA9 presented in SEQ ID NO: 294.

SEQ ID NOs: 296-300 are human CA9 alternative reading frame polypeptides derived from the polynucleotide sequence presented herein as SEQ ID NO: 295.

SEQ ID NO: 301 is the amino acid sequence of human carcinoembryonic antigen (hCEA; Genbank Accession No. M17303).

SEQ ID NO: 302 is the nucleotide sequence of the polynucleotide encoding the amino acid sequence of hCEA presented in SEQ ID NO: 301.

SEQ ID NOs: 303-319 are human CEA alternative reading frame polypeptides derived from the polynucleotide sequence presented herein as SEQ ID NO: 302.

SEQ ID NO: 320 is the amino acid sequence of the full-length sequence of hCA9 rf1 derived by deleting stop codons (TGA, TAA, and TAG) and by deleting residues between stop codons that encode less than 9 consecutive residues.

SEQ ID NO: 321 is the nucleotide sequence encoding the full-length amino acid sequence of hCA9 rf1 depicted in SEQ ID NO: 320.

SEQ ID NO: 322 is the amino acid sequence of the full-length sequence of hCA9 rf2 derived by deleting stop codons (TGA, TAA, and TAG) and by deleting residues between stop codons that encode less than 9 consecutive residues.

SEQ ID NO: 323 is the nucleotide sequence encoding the full-length amino acid sequence of hCA9 rf2 depicted in SEQ ID NO: 322.

SEQ ID NO: 324 is the amino acid sequence of the full-length sequence of hCEA rf1 derived by deleting stop codons (TGA, TAA, and TAG) and by deleting residues between stop codons that encode less than 9 consecutive residues.

SEQ ID NO: 325 is the nucleotide sequence encoding the full-length amino acid sequence of hCEA rf1 depicted in SEQ ID NO: 324.

SEQ ID NO: 326 is the amino acid sequence of the full-length sequence of hCEA rf2 derived by deleting stop codons (TGA, TAA, and TAG) and by deleting residues between stop codons that encode less than 9 consecutive residues.

SEQ ID NO: 327 is the nucleotide sequence encoding the full-length amino acid sequence of hCEA rf2 depicted in SEQ ID NO: 326.

SEQ ID NO: 328 is the amino acid sequence of the full-length sequence of hHER2 rf1 derived by deleting stop codons (TGA, TAA, and TAG) and by deleting residues between stop codons that encode less than 9 consecutive residues.

SEQ ID NO: 329 is the nucleotide sequence encoding the full-length amino acid sequence of hHER2 rf1 depicted in SEQ ID NO: 328.

SEQ ID NO: 330 is the amino acid sequence of the full-length sequence of hHER2 rf2 derived by deleting stop codons (TGA, TAA, and TAG) and by deleting residues between stop codons that encode less than 9 consecutive residues.

SEQ ID NO: 331 is the nucleotide sequence encoding the full-length amino acid sequence of hHER2 rf2 depicted in SEQ ID NO: 330.

SEQ ID NO: 332 is the amino acid sequence of the full-length sequence of hPAP rf1 derived by deleting stop codons (TGA, TAA, and TAG) and by deleting residues between stop codons that encode less than 9 consecutive residues.

SEQ ID NO: 333 is the nucleotide sequence encoding the full-length amino acid sequence of hPAP rf1 depicted in SEQ ID NO: 332.

SEQ ID NO: 334 is the amino acid sequence of the full-length sequence of hPAP rf2 derived by deleting stop codons (TGA, TAA, and TAG) and by deleting residues between stop codons that encode less than 9 consecutive residues.

SEQ ID NO: 335 is the nucleotide sequence encoding the full-length amino acid sequence of hPAP rf2 depicted in SEQ ID NO: 334.

SEQ ID NO: 336 is the amino acid sequence of the full-length sequence of hTERT rf1 derived by deleting stop codons (TGA, TAA, and TAG) and by deleting residues between stop codons that encode less than 9 consecutive residues.

SEQ ID NO: 337 is the nucleotide sequence encoding the full-length amino acid sequence of hTERT rf1 depicted in SEQ ID NO: 336.

SEQ ID NO: 338 is the amino acid sequence of the full-length sequence of hTERT rf2 derived by deleting stop codons (TGA, TAA, and TAG) and by deleting residues between stop codons that encode less than 9 consecutive residues.

SEQ ID NO: 339 is the nucleotide sequence encoding the full-length amino acid sequence of hTERT rf2 depicted in SEQ ID NO: 338.

SEQ ID NO: 340 is the amino acid sequence of the full-length sequence of hTrpP8 rf1 derived by deleting stop codons (TGA, TAA, and TAG) and by deleting residues between stop codons that encode less than 9 consecutive residues.

SEQ ID NO: 341 is the nucleotide sequence encoding the full-length amino acid sequence of hTrpP8 rf1 depicted in SEQ ID NO: 340.

SEQ ID NO: 342 is the amino acid sequence of the full-length sequence of hTrpP8 rf2 derived by deleting stop codons (TGA, TAA, and TAG) and by deleting residues between stop codons that encode less than 9 consecutive residues.

SEQ ID NO: 343 is the nucleotide sequence encoding the full-length amino acid sequence of hTrpP8 rf2 depicted in SEQ ID NO: 342.

SEQ ID NO: 344 is the amino acid sequence of human prostate-specific membrane antigen (hPSMA; Genbank Accession No. NM_004467).

SEQ ID NO: 345 is the nucleotide sequence of the polynucleotide encoding the amino acid sequence of hPSMA presented in SEQ ID NO: 344.

SEQ ID NO: 346 is the amino acid sequence of the full-length sequence of hPSMA rf1 derived by deleting stop codons (TGA, TAA, and TAG) and by deleting residues between stop codons that encode less than 9 consecutive residues.

SEQ ID NO: 347 is the nucleotide sequence encoding the full-length amino acid sequence of hPSMA rf1 depicted in SEQ ID NO: 346.

SEQ ID NO: 348 is the amino acid sequence of the full-length sequence of hPSMA rf2 derived by deleting stop codons (TGA, TAA, and TAG) and by deleting residues between stop codons that encode less than 9 consecutive residues.

SEQ ID NO: 349 is the nucleotide sequence encoding the full-length amino acid sequence of hPSMA rf2 depicted in SEQ ID NO: 346.

SEQ ID NO: 350-367 are human PSMA alternative reading frame polypeptides derived from the polynucleotide sequence presented herein as SEQ ID NO: 345.

SEQ ID NO: 368 is the amino acid sequence of human prostate-specific antigen (hPSA; Genbank Accession No. M26663).

SEQ ID NO: 369 is the nucleotide sequence of the polynucleotide encoding the amino acid sequence of hPSA presented in SEQ ID NO: 368.

SEQ ID NO: 370 is the amino acid sequence of the full-length sequence of hPSA rf1 derived by deleting stop codons (TGA, TAA, and TAG) and by deleting residues between stop codons that encode less than 9 consecutive residues.

SEQ ID NO: 371 is the nucleotide sequence encoding the full-length amino acid sequence of hPSA rf1 depicted in SEQ ID NO: 370.

SEQ ID NO: 372 is the amino acid sequence of the full-length sequence of hPSA rf2 derived by deleting stop codons (TGA, TAA, and TAG) and by deleting residues between stop codons that encode less than 9 consecutive residues.

SEQ ID NO: 373 is the nucleotide sequence encoding the full-length amino acid sequence of hPSA rf2 depicted in SEQ ID NO: 372.

SEQ ID NO: 374-379 are human PSA alternative reading frame polypeptides derived from the polynucleotide sequence presented herein as SEQ ID NO: 369.

SEQ ID NO: 380 is the amino acid sequence of human p53 cellular tumor antigen (hp53; Genbank Accession No. M14695).

SEQ ID NO: 381 is the nucleotide sequence of the polynucleotide encoding the amino acid sequence of hp53 presented in SEQ ID NO: 380.

SEQ ID NO: 382 is the amino acid sequence of the full-length sequence of hp53 rf1 derived by deleting stop codons (TGA, TAA, and TAG) and by deleting residues between stop codons that encode less than 9 consecutive residues.

SEQ ID NO: 383 is the nucleotide sequence encoding the full-length amino acid sequence of hp53 rf1 depicted in SEQ ID NO: 382.

SEQ ID NO: 384 is the amino acid sequence of the full-length sequence of hp53 rf2 derived by deleting stop codons (TGA, TAA, and TAG) and by deleting residues between stop codons that encode less than 9 consecutive residues.

SEQ ID NO: 385 is the nucleotide sequence encoding the full-length amino acid sequence of hp53 rf2 depicted in SEQ ID NO: 384.

SEQ ID NO: 386-390 are human p53 alternative reading frame polypeptides derived from the polynucleotide sequence presented herein as SEQ ID NO: 381.

SEQ ID NO: 391 is the amino acid sequence of human P-glycoprotein (hPGY1; Genbank Accession No. M14758).

SEQ ID NO: 392 is the nucleotide sequence of the polynucleotide encoding the amino acid sequence of hPGY1 presented in SEQ ID NO: 391.

SEQ ID NO: 393 is the amino acid sequence of the full-length sequence of hPGY1 rf1 derived by deleting stop codons (TGA, TAA, and TAG) and by deleting residues between stop codons that encode less than 9 consecutive residues.

SEQ ID NO: 394 is the nucleotide sequence encoding the full-length amino acid sequence of hPGY1 rf1 depicted in SEQ ID NO: 393.

SEQ ID NO: 395 is the amino acid sequence of the full-length sequence of hPGY1 rf2 derived by deleting stop codons (TGA, TAA, and TAG) and by deleting residues between stop codons that encode less than 9 consecutive residues.

SEQ ID NO: 396 is the nucleotide sequence encoding the full-length amino acid sequence of hPGY1 rf2 depicted in SEQ ID NO: 395.

SEQ ID NO: 397-422 are human PGY1 alternative reading frame polypeptides derived from the polynucleotide sequence presented herein as SEQ ID NO: 392.

SEQ ID NO: 423 is the amino acid sequence of human alpha-fetoprotein (hAFP; Genbank Accession No. NM_001134).

SEQ ID NO: 424 is the nucleotide sequence of the polynucleotide encoding the amino acid sequence of hAFP presented in SEQ ID NO: 423.

SEQ ID NO: 425 is the amino acid sequence of the full-length sequence of hAFP rf1 derived by deleting stop codons (TGA, TAA, and TAG) and by deleting residues between stop codons that encode less than 9 consecutive residues.

SEQ ID NO: 426 is the nucleotide sequence encoding the full-length amino acid sequence of hAFP rf1 depicted in SEQ ID NO: 425.

SEQ ID NO: 427 is the amino acid sequence of the full-length sequence of hAFP rf2 derived by deleting stop codons (TGA, TAA, and TAG) and by deleting residues between stop codons that encode less than 9 consecutive residues.

SEQ ID NO: 428 is the nucleotide sequence encoding the full-length amino acid sequence of hAFP rf2 depicted in SEQ ID NO: 427.

SEQ ID NO: 429-439 are human AFP alternative reading frame polypeptides derived from the polynucleotide sequence presented herein as SEQ ID NO: 424.

SEQ ID NO: 440 is the amino acid sequence of human mucin precursor (hMUC1; Genbank Accession No. AF125525).

SEQ ID NO: 441 is the nucleotide sequence of the polynucleotide encoding the amino acid sequence of hMUC1 presented in SEQ ID NO: 440.

SEQ ID NO: 442 is the amino acid sequence of the full-length sequence of hMUC1 rf1 derived by deleting stop codons (TGA, TAA, and TAG) and by deleting residues between stop codons that encode less than 9 consecutive residues.

SEQ ID NO: 443 is the nucleotide sequence encoding the full-length amino acid sequence of hMUC1 rf1 depicted in SEQ ID NO: 442.

SEQ ID NO: 444 is the amino acid sequence of the full-length sequence of hMUC1 rf2 derived by deleting stop codons (TGA, TAA, and TAG) and by deleting residues between stop codons that encode less than 9 consecutive residues.

SEQ ID NO: 445 is the nucleotide sequence encoding the full-length amino acid sequence of hMUC1 rf2 depicted in SEQ ID NO: 444.

SEQ ID NO: 446-450 are human MUC1 alternative reading frame polypeptides derived from the polynucleotide sequence presented herein as SEQ ID NO: 442.

SEQ ID NO: 451 is the amino acid sequence of human preferentially expressed antigen of melanoma (hPRAME; Genbank Accession No. U65011).

SEQ ID NO: 452 is the nucleotide sequence of the polynucleotide encoding the amino acid sequence of hPRAME presented in SEQ ID NO: 451.

SEQ ID NO: 453 is the amino acid sequence of the full-length sequence of hPRAME rf1 derived by deleting stop codons (TGA, TAA, and TAG) and by deleting residues between stop codons that encode less than 9 consecutive residues.

SEQ ID NO: 454 is the nucleotide sequence encoding the full-length amino acid sequence of hPRAME rf1 depicted in SEQ ID NO: 453.

SEQ ID NO: 455 is the amino acid sequence of the full-length sequence of hPRAME rf2 derived by deleting stop codons (TGA, TAA, and TAG) and by deleting residues between stop codons that encode less than 9 consecutive residues.

SEQ ID NO: 456 is the nucleotide sequence encoding the full-length amino acid sequence of hPRAME rf2 depicted in SEQ ID NO: 455.

SEQ ID NO: 457-466 are human PRAME alternative reading frame polypeptides derived from the polynucleotide sequence presented herein as SEQ ID NO: 452.

SEQ ID NO: 467 is the amino acid sequence of human ephrin receptor (hEPHA3; Genbank Accession No. AF213459).

SEQ ID NO: 468 is the nucleotide sequence of the polynucleotide encoding the amino acid sequence of hEPHA3 presented in SEQ ID NO: 467.

SEQ ID NO: 469 is the amino acid sequence of the full-length sequence of hEPHA3 rf1 derived by deleting stop codons (TGA, TAA, and TAG) and by deleting residues between stop codons that encode less than 9 consecutive residues.

SEQ ID NO: 470 is the nucleotide sequence encoding the full-length amino acid sequence of hEPHA3 rf1 depicted in SEQ ID NO: 469.

SEQ ID NO: 471 is the amino acid sequence of the full-length sequence of hEPHA3 rf2 derived by deleting stop codons (TGA, TAA, and TAG) and by deleting residues between stop codons that encode less than 9 consecutive residues.

SEQ ID NO: 472 is the nucleotide sequence encoding the full-length amino acid sequence of hEPHA3 rf2 depicted in SEQ ID NO: 471.

SEQ ID NO: 473-494 are human EPHA3 alternative reading frame polypeptides derived from the polynucleotide sequence presented herein as SEQ ID NO: 468.

SEQ ID NO: 495 is the amino acid sequence of human peptidyl-prolyl isomerase and essential mitotic regulator (hPIN1; Genbank Accession No. U49070).

SEQ ID NO: 496 is the nucleotide sequence of the polynucleotide encoding the amino acid sequence of hPIN1 presented in SEQ ID NO: 495.

SEQ ID NO: 497 is the amino acid sequence of the full-length sequence of hPIN1 rf1 derived by deleting stop codons (TGA, TAA, and TAG) and by deleting residues between stop codons that encode less than 9 consecutive residues.

SEQ ID NO: 498 is the nucleotide sequence encoding the full-length amino acid sequence of hPIN1 rf1 depicted in SEQ ID NO: 497.

SEQ ID NO: 499 is the amino acid sequence of the full-length sequence of hPIN1 rf2 derived by deleting stop codons (TGA, TAA, and TAG) and by deleting residues between stop codons that encode less than 9 consecutive residues.

SEQ ID NO: 500 is the nucleotide sequence encoding the full-length amino acid sequence of hPIN1 rf2 depicted in SEQ ID NO: 499.

SEQ ID NO: 501-502 are human PIN1 alternative reading frame polypeptides derived from the polynucleotide sequence presented herein as SEQ ID NO: 496.

SEQ ID NO: 503 is the amino acid sequence of human BASE (hBASE; Genbank Accession No. AY180924).

SEQ ID NO: 504 is the nucleotide sequence of the polynucleotide encoding the amino acid sequence of hBASE presented in SEQ ID NO: 503.

SEQ ID NO: 505 is the amino acid sequence of the full-length sequence of hBASE rf1 derived by deleting stop codons (TGA, TAA, and TAG) and by deleting residues between stop codons that encode less than 9 consecutive residues.

SEQ ID NO: 506 is the nucleotide sequence encoding the fill-length amino acid sequence of hBASE rf1 depicted in SEQ ID NO: 505.

SEQ ID NO: 507 is the amino acid sequence of the full-length sequence of hBASE rf2 derived by deleting stop codons (TGA, TAA, and TAG) and by deleting residues between stop codons that encode less than 9 consecutive residues.

SEQ ID NO: 508 is the nucleotide sequence encoding the full-length amino acid sequence of hBASE rf2 depicted in SEQ ID NO: 507.

SEQ ID NO: 509-513 are human BASE alternative reading frame polypeptides derived from the polynucleotide sequence presented herein as SEQ ID NO: 504.

SEQ ID NO: 514 is the amino acid sequence of human prostate stem cell antigen (hPSCA; Genbank Accession No. AF043498).

SEQ ID NO: 515 is the nucleotide sequence of the polynucleotide encoding the amino acid sequence of hPSCA presented in SEQ ID NO: 514.

SEQ ID NO: 516 is the amino acid sequence of the full-length sequence of hPSCA rf1 derived by deleting stop codons (TGA, TAA, and TAG) and by deleting residues between stop codons that encode less than 9 consecutive residues.

SEQ ID NO: 517 is the nucleotide sequence encoding the full-length amino acid sequence of hPSCA rf1 depicted in SEQ ID NO: 516.

SEQ ID NO: 518 is the amino acid sequence of the full-length sequence of hPSCA rf2 derived by deleting stop codons (TGA, TAA, and TAG) and by deleting residues between stop codons that encode less than 9 consecutive residues.

SEQ ID NO: 519 is the nucleotide sequence encoding the full-length amino acid sequence of hPSCA rf2 depicted in SEQ ID NO: 518.

SEQ ID NO: 520-521 are human PSCA alternative reading frame polypeptides derived from the polynucleotide sequence presented herein as SEQ ID NO: 515.

SEQ ID NO: 522 is the nucleotide sequence of a forward primer for PCR analysis of mTERT mRNA expression.

SEQ ID NO: 523 is the nucleotide sequence of a reverse primer for PCR analysis of mTERT mRNA expression.

SEQ ID NO: 524 is the nucleotide sequence of a forward primer for PCR analysis of mHPRT mRNA expression.

SEQ ID NO: 525 is the nucleotide sequence of a reverse primer for PCR analysis of mHPRT mRNA expression.

SEQ ID NO: 526 is the amino acid sequence of the hPAP alternative reading frame peptide designated herein as 3-41/rf2-3.

SEQ ID NO: 527 is the amino acid sequence of the hPAP alternative reading frame peptide designated herein as 5-76/rf1-5a.

SEQ ID NO: 528 is the amino acid sequence of the hPAP alternative reading frame peptide designated herein as 5-76/rf1-5b.

SEQ ID NO: 529 is the amino acid sequence of the hPAP alternative reading frame peptide designated herein as 5-76/rf1-5c.

SEQ ID NO: 530 is the amino acid sequence of the hPAP alternative reading frame peptide designated herein as 131-172/rf1-131.

SEQ ID NO: 531 is the amino acid sequence of the hPAP alternative reading frame peptide designated herein as 186-236/rf2-186.

SEQ ID NO: 532 is the amino acid sequence of the hPAP alternative reading frame peptide designated herein as 281-337/rf1-281a.

SEQ ID NO: 533 is the amino acid sequence of the hPAP alternative reading frame peptide designated herein as 281-337/rf1-281b.

SEQ ID NO: 534 is the amino acid sequence of the hPAP alternative reading frame peptide designated herein as 593-694/rf1-593a.

SEQ ID NO: 535 is the amino acid sequence of the hPAP alternative reading frame peptide designated herein as 593-694/rf1-593b.

SEQ ID NO: 536 is the amino acid sequence of the hPAP alternative reading frame peptide designated herein as 593-694/rf1-593c.

SEQ ID NO: 537 is the amino acid sequence of the hPAP alternative reading frame peptide designated herein as 593-694/rf1-593d.

SEQ ID NO: 538 is the amino acid sequence of the hPAP alternative reading frame peptide designated herein as 593-694/rf1-593e.

SEQ ID NO: 539 is the amino acid sequence of the hPAP alternative reading frame peptide designated herein as 593-694/rf1-593f.

SEQ ID NO: 540 is the amino acid sequence of the hPAP alternative reading frame peptide designated herein as 740-811/rf1-740a.

SEQ ID NO: 541 is the amino acid sequence of the hPAP alternative reading frame peptide designated herein as 740-811/rf1-740b.

SEQ ID NO: 542 is the amino acid sequence of the hPAP alternative reading frame peptide designated herein as 740-811/rf1-740c.

SEQ ID NO: 543 is the amino acid sequence of the hPAP alternative reading frame peptide designated herein as 902-943/rf1-902.

SEQ ID NO: 544 is the amino acid sequence of the hPAP alternative reading frame peptide designated herein as 998-1087/rf1-998a.

SEQ ID NO: 545 is the amino acid sequence of the hPAP alternative reading frame peptide designated herein as 998-1087/rf1-998b.

SEQ ID NO: 546 is the amino acid sequence of the hPAP alternative reading frame peptide designated herein as 998-1087/rf1-998c.

SEQ ID NO: 547 is the amino acid sequence of the hPAP alternative reading frame peptide designated herein as 998-1087/rf1-998d.

SEQ ID NO: 548 is the amino acid sequence of the hPAP alternative reading frame peptide designated herein as 998-1087/rf1-998e.

SEQ ID NO: 549 is the nucleotide sequence of human SURVIVIN (Genbank Accession No. AF077350).

SEQ ID NO: 550 is the amino acid sequences of the polypeptide encoded by the human SURVIVIN nucleotide sequence presented in SEQ ID NO: 549.

SEQ ID NO: 551 is the amino acid sequence of the hSURVIVIN alternative reading frame peptide designated herein as 2-220 rf1-2.

SEQ ID NO: 552 is the amino acid sequence of the hSURVIVIN alternative reading frame peptide designated herein as 3-143 rf2-3.

SEQ ID NO: 553 is the amino acid sequence of the hSURVIVIN alternative reading frame rf1.

SEQ ID NO: 554 is the nucleotide sequence encoding the hSURVIVIN alternative reading frame rf1 presented herein as SEQ ID NO: 553.

SEQ ID NO: 555 is the amino acid sequence of the hSURVIVIN alternative reading frame rf2.

SEQ ID NO: 556 is the nucleotide sequence encoding the hSURVIVIN alternative reading frame rf2 presented herein as SEQ ID NO: 555.

SEQ ID NO: 557 is the nucleotide sequence of human WTI (Genbank Accession No. NM_000378).

SEQ ID NO: 558 is the amino acid sequence of hWTI encoded by the nucleotide sequence presented herein as SEQ ID NO: 557.

SEQ ID NO: 559 is the amino acid sequence of the hWTI alternative reading frame peptide designated herein as 3-386 rf2-3.

SEQ ID NO: 560 is the amino acid sequence of the hWTI alternative reading frame peptide designated herein as 500-649 rf1-500.

SEQ ID NO: 561 is the amino acid sequence of the hWTI alternative reading frame peptide designated herein as 702-770 rf2-702.

SEQ ID NO: 562 is the amino acid sequence of the hWTI alternative reading frame rf1.

SEQ ID NO: 563 is the nucleotide sequence encoding the hWTI alternative reading frame rf1 presented herein as SEQ ID NO: 562.

SEQ ID NO: 564 is the amino acid sequence of the hWTI alternative reading frame rf2.

SEQ ID NO: 565 is the nucleotide sequence encoding the hWTI alternative reading frame rf2 presented herein as SEQ ID NO: 564.

SEQ ID NO: 566 is the nucleotide sequence of human SGA-M1 (Genbank Accession No. AY192728).

SEQ ID NO: 567 is the amino acid sequence of hSGA-M1 presented herein as SEQ ID NO: 566.

SEQ ID NO: 568 is the amino acid sequence of the hSGA-M1 alternative reading frame peptide designated herein as 2-92 rf1-2.

SEQ ID NO: 569 is the amino acid sequence of the hSGA-M1 alternative reading frame peptide designated herein as 3-71 rf2-3.

SEQ ID NO: 570 is the amino acid sequence of the hSGA-M1 alternative reading frame peptide designated herein as 71-205 rf1-71.

SEQ ID NO: 571 is the amino acid sequence of the hSGA-M1 alternative reading frame peptide designated herein as 227-328 rf1-227.

SEQ ID NO: 572 is the amino acid sequence of the hSGA-M1 alternative reading frame peptide designated herein as 440-469 rf1-440.

SEQ ID NO: 573 is the amino acid sequence of the hSGA-M1 alternative reading frame peptide designated herein as 477-521 rf2-477.

SEQ ID NO: 574 is the amino acid sequence of the hSGA-M1 alternative reading frame peptide designated herein as 524-559 rf2-524.

SEQ ID NO: 575 is the amino acid sequence of the hSGA-M1 alternative reading frame rf1.

SEQ ID NO: 576 is the nucleotide sequence encoding the hSGA-M1 alternative reading frame rf1 presented herein as SEQ ID NO: 575.

SEQ ID NO: 577 is the amino acid sequence of the hSGA-M1 alternative reading frame rf2.

SEQ ID NO: 578 is the nucleotide sequence encoding the hSGA-M1 alternative reading frame rf1 presented herein as SEQ ID NO: 577.

SEQ ID NO: 579 is the nucleotide sequence of human RCAS1 (Genbank Accession No. AF006265).

SEQ ID NO: 580 is the amino acid sequence of hRCAS1 encoded by the nucleotide sequence presented herein as SEQ ID NO: 579.

SEQ ID NO: 581 is the amino acid sequence of the hRCAS1 alternative reading frame peptide designated herein as 2-43 rf1-2.

SEQ ID NO: 582 is the amino acid sequence of the hRCAS1 alternative reading frame peptide designated herein as 78-137 rf2-78.

SEQ ID NO: 583 is the amino acid sequence of the hRCAS1 alternative reading frame peptide designated herein as 167-211 rf1-167.

SEQ ID NO: 584 is the amino acid sequence of the hRCAS1 alternative reading frame peptide designated herein as 230-292 rf1-230.

SEQ ID NO: 585 is the amino acid sequence of the hRCAS1 alternative reading frame peptide designated herein as 365-391 rf1-365.

SEQ ID NO: 586 is the amino acid sequence of the hRCAS1 alternative reading frame peptide designated herein as 470-641 rf2-470.

SEQ ID NO: 587 is the amino acid sequence of the hRCAS1 alternative reading frame peptide designated herein as 474-517 rf1-474.

SEQ ID NO: 588 is the amino acid sequence of the hRCAS1 alternative reading frame rf1.

SEQ ID NO: 589 is the nucleotide sequence encoding the hRCAS1 alternative reading frame rf1 presented herein as SEQ ID NO: 588.

SEQ ID NO: 590 is the amino acid sequence of the hRCAS1 alternative reading frame rf2.

SEQ ID NO: 591 is the nucleotide sequence encoding the hRCAS1 alternative reading frame rf1 presented herein as SEQ ID NO: 590.

SEQ ID NO: 592 is the nucleotide sequence of human CYP1B1 (Genbank Accession No. NM_000104).

SEQ ID NO: 593 is the amino acid sequence of CYP1B1 encoded by the nucleotide sequence presented herein as SEQ ID NO: 592.

SEQ ID NO: 594 is the amino acid sequence of the hCYP1B1 alternative reading frame peptide designated herein as 2-37 rf1-2.

SEQ ID NO: 595 is the amino acid sequence of the hCYP1B1 alternative reading frame peptide designated herein as 293-451 rf1-293.

SEQ ID NO: 596 is the amino acid sequence of the hCYP1B1 alternative reading frame peptide designated herein as 1052-1279 rf1-1052.

SEQ ID NO: 597 is the amino acid sequence of the hCYP1B1 alternative reading frame peptide designated herein as 1556-1630 rf1-1556.

SEQ ID NO: 598 is the amino acid sequence of the hCYP1B1 alternative reading frame peptide designated herein as 3-665 rf2-3.

SEQ ID NO: 599 is the amino acid sequence of the hCYP1B1 alternative reading frame rf1.

SEQ ID NO: 600 is the nucleotide sequence encoding the hCYP1B1 alternative reading frame rf1 presented herein as SEQ ID NO: 599.

SEQ ID NO: 601 is the amino acid sequence of the hCYP1B1 alternative reading frame rf2.

SEQ ID NO: 602 is the nucleotide sequence encoding the hCYP1B1 alternative reading frame rf2 presented herein as SEQ ID NO: 601.

SEQ ID NO: 603 is the nucleotide sequence of hAFP (Genbank Accession No. NM_001134) 5' UTR.

SEQ ID NO: 604 is the amino acid sequence of hAFP 5' UTR alternative reading frame rf0 peptides.

SEQ ID NO: 605 is the amino acid sequence of hAFP 5' UTR alternative reading frame rf0 peptide A.

SEQ ID NO: 606 is the amino acid sequence of hAFP 5' UTR alternative reading frame rf1 peptides.

SEQ ID NO: 607 is the amino acid sequence of hAFP 5' UTR alternative reading frame rf1 peptide A.

SEQ ID NO: 608 is amino acid sequence of hAFP 5' UTR alternative reading frame rf2 peptide.

SEQ ID NO: 609 is the nucleotide sequence of hBASE (Genbank Accession No. AY180924) 5' UTR.

SEQ ID NO: 610 is the amino acid sequence of hBASE 5' UTR alternative reading frame rf0 peptides.

SEQ ID NO: 611 is the amino acid sequence of hBASE 5' UTR alternative reading frame rf0 peptide A.

SEQ ID NO: 612 is the amino acid sequence of hBASE 5' UTR alternative reading frame rf1 peptides.

SEQ ID NO: 613 is the amino acid sequence of hBASE 5' UTR alternative reading frame rf1 peptide A.

SEQ ID NO: 614 is the amino acid sequence of hBASE 5' UTR alternative reading frame rf2 peptides.

SEQ ID NO: 615 is the nucleotide sequence of hCA9 (Genbank Accession No. NM_001216) 5' UTR.

SEQ ID NO: 616 is the amino acid sequence of hCA9 5' UTR alternative reading frame rf0 peptides.

SEQ ID NO: 617 is the amino acid sequence of hCA9 5' UTR alternative reading frame rf1 peptides.

SEQ ID NO: 618 is the amino acid sequence of hCA9 5' UTR alternative reading frame rf2 peptides.

SEQ ID NO: 619 is the nucleotide sequence of hCEA (Genbank Accession No. M17303) 5' UTR.

SEQ ID NO: 620 is the amino acid sequence of hCEA 5' UTR alternative reading frame rf0 peptides.

SEQ ID NO: 621 is the amino acid sequence of hCEA 5' UTR alternative reading frame rf1 peptides.

SEQ ID NO: 622 is the amino acid sequence of hCEA 5' UTR alternative reading frame rf1 peptide A.

SEQ ID NO: 623 is the amino acid sequence of hCEA 5' UTR alternative reading frame rf1 peptide B.

SEQ ID NO: 624 is the amino acid sequence of hCEA 5' UTR alternative reading frame rf2 peptides.

SEQ ID NO: 625 is the nucleotide sequence of hCYP1B1 (Genbank Accession No. NM_000104) 5' UTR.

SEQ ID NO: 626 is the amino acid sequence of hCYPB1 5' UTR alternative reading frame rf0 peptides.

SEQ ID NO: 627 is the amino acid sequence of hCYPB1 5' UTR alternative reading frame rf0 peptide A.

SEQ ID NO: 628 is the amino acid sequence of hCYPB1 5' UTR alternative reading frame rf0 peptide B.

SEQ ID NO: 629 is the amino acid sequence of hCYPB1 5' UTR alternative reading frame rf0 peptide C.

SEQ ID NO: 630 is the amino acid sequence of hCYPB1 5' UTR alternative reading frame rf1 peptides.

SEQ ID NO: 631 is the amino acid sequence of hCYPB1 5' UTR alternative reading frame rf1 peptide A.

SEQ ID NO: 632 is the amino acid sequence of hCYPB1 5' UTR alternative reading frame rf1 peptide B.

SEQ ID NO: 633 is the amino acid sequence of hCYPB1 5' UTR alternative reading frame rf1 peptide C.

SEQ ID NO: 634 is the amino acid sequence of hCYPB1 5' UTR alternative reading frame rf2 peptides.

SEQ ID NO: 635 is the amino acid sequence of hCYPB1 5' UTR alternative reading frame rf2 peptide A.

SEQ ID NO: 636 is the amino acid sequence of hCYPB1 5' UTR alternative reading frame rf2 peptide B.

SEQ ID NO: 637 is the amino acid sequence of hCYPB1 5' UTR alternative reading frame rf2 peptide C.

SEQ ID NO: 638 is the nucleotide sequence of hEphA3 (Genbank Accession No. AF213459) 5' UTR.

SEQ ID NO: 639 is the amino acid sequence of hEphA3 5' UTR alternative reading frame rf0 peptides.

SEQ ID NO: 640 is the amino acid sequence of hEphA3 5' UTR alternative reading frame rf0 peptide A.

SEQ ID NO: 641 is the amino acid sequence of hEphA3 5' UTR alternative reading frame rf0 peptide B.

SEQ ID NO: 642 is the amino acid sequence of hEphA3 5' UTR alternative reading frame rf1 peptides.

SEQ ID NO: 643 is the amino acid sequence of hEphA3 5' UTR alternative reading frame rf1 peptide A.

SEQ ID NO: 644 is the amino acid sequence of hEphA3 5' UTR alternative reading frame rf2 peptides.

SEQ ID NO: 645 is the nucleotide sequence of hHER2 (Genbank Accession No. M_11730) 5' UTR.

SEQ ID NO: 646 is the amino acid sequence of hHER2 5' UTR alternative reading frame rf0 peptides.

SEQ ID NO: 647 is the amino acid sequence of hHER2 5' UTR alternative reading frame rf1 peptides.

SEQ ID NO: 648 is the amino acid sequence of hHER2 5' UTR alternative reading frame rf1 peptide A.

SEQ ID NO: 649 is the amino acid sequence of hHER2 5' UTR alternative reading frame rf2 peptides.

SEQ ID NO: 650 is the nucleotide sequence of hMDR1 (Genbank Accession No. M_14758) 5' UTR.

SEQ ID NO: 651 is the amino acid sequence of hMDR1 5' UTR alternative reading frame rf0 peptides.

SEQ ID NO: 652 is the amino acid sequence of hMDR1 5' UTR alternative reading frame rf0 peptide A.

SEQ ID NO: 653 is the amino acid sequence of hMDR1 5' UTR alternative reading frame rf0 peptide B.

SEQ ID NO: 654 is the amino acid sequence of hMDR1 5' UTR alternative reading frame rf0 peptide C.

SEQ ID NO: 655 is the amino acid sequence of hMDR1 5' UTR alternative reading frame rf0 peptide D.

SEQ ID NO: 656 is the amino acid sequence of hMDR1 5' UTR alternative reading frame rf0 peptide E.

SEQ ID NO: 657 is the amino acid sequence of hMDR1 5' UTR alternative reading frame rf1 peptides.

SEQ ID NO: 658 is the amino acid sequence of hMDR1 5' UTR alternative reading frame rf1 peptide A.

SEQ ID NO: 659 is the amino acid sequence of hMDR1 5' UTR alternative reading frame rf1 peptide B.

SEQ ID NO: 660 is the amino acid sequence of hMDR1 5' UTR alternative reading frame rf1 peptide C.

SEQ ID NO: 661 is the amino acid sequence of hMDR1 5' UTR alternative reading frame rf1 peptide D.

SEQ ID NO: 662 is the amino acid sequence of hMDR1 5' UTR alternative reading frame rf1 peptide E.

SEQ ID NO: 663 is the amino acid sequence of hHER2 5' UTR alternative reading frame rf2 peptides.

SEQ ID NO: 664 is the amino acid sequence of hHER2 5' UTR alternative reading frame rf2 peptide A.

SEQ ID NO: 665 is the amino acid sequence of hHER2 5' UTR alternative reading frame rf2 peptide B.

SEQ ID NO: 666 is the amino acid sequence of hHER2 5' UTR alternative reading frame rf2 peptide C.

SEQ ID NO: 667 is the nucleotide sequence of hP53 (Genbank Accession No. M_14495) 5' UTR.

SEQ ID NO: 668 is the amino acid sequence of hP53 5' UTR alternative reading frame rf0 peptides.

SEQ ID NO: 669 is the amino acid sequence of hP53 5' UTR alternative reading frame rf0 peptide A.

SEQ ID NO: 670 is the amino acid sequence of hP53 5' UTR alternative reading frame rf1 peptides.

SEQ ID NO: 671 is the amino acid sequence of hP53 5' UTR alternative reading frame rf2 peptides.

SEQ ID NO: 672 is the amino acid sequence of hP53 5' UTR alternative reading frame rf2 peptide A.

SEQ ID NO: 673 is the amino acid sequence of hP53 5' UTR alternative reading frame rf2 peptide B.

SEQ ID NO: 674 is the nucleotide sequence of hPRAME (Genbank Accession No. U65011) 5' UTR.

SEQ ID NO: 675 is the amino acid sequence of hPRAME 5' UTR alternative reading frame rf0 peptides.

SEQ ID NO: 676 is the amino acid sequence of hPRAME 5' UTR alternative reading frame rf0 peptide A.

SEQ ID NO: 677 is the amino acid sequence of hPRAME 5' UTR alternative reading frame rf0 peptide B.

SEQ ID NO: 678 is the amino acid sequence of hPRAME 5' UTR alternative reading frame rf0 peptide C.

SEQ ID NO: 679 is the amino acid sequence of hPRAME 5' UTR alternative reading frame rf1 peptides.

SEQ ID NO: 680 is the amino acid sequence of hPRAME 5' UTR alternative reading frame rf1 peptide A.

SEQ ID NO: 681 is the amino acid sequence of hPRAME 5' UTR alternative reading frame rf1 peptide B.

SEQ ID NO: 682 is the amino acid sequence of hPRAME 5' UTR alternative reading frame rf2 peptides.

SEQ ID NO: 683 is the amino acid sequence of hPRAME 5' UTR alternative reading frame rf2 peptide A.
SEQ ID NO: 684 is the amino acid sequence of hPRAME 5' UTR alternative reading frame rf2 peptide B.
SEQ ID NO: 685 is the amino acid sequence of hPRAME 5' UTR alternative reading frame rf2 peptide C.
SEQ ID NO: 686 is the nucleotide sequence of hPSMA (Genbank Accession No. NM004476) 5' UTR.
SEQ ID NO: 687 is the amino acid sequence of hPSMA 5' UTR alternative reading frame rf0 peptides.
SEQ ID NO: 688 is the amino acid sequence of hPSMA 5' UTR alternative reading frame rf0 peptide A.
SEQ ID NO: 689 is the amino acid sequence of hPSMA 5' UTR alternative reading frame rf0 peptide B.
SEQ ID NO: 690 is the amino acid sequence of hPSMA 5' UTR alternative reading frame rf1 peptides.
SEQ ID NO: 691 is the amino acid sequence of hPSMA 5' UTR alternative reading frame rf1 peptide A.
SEQ ID NO: 692 is the amino acid sequence of hPSMA 5' UTR alternative reading frame rf1 peptide B.
SEQ ID NO: 693 is the amino acid sequence of hPSMA 5' UTR alternative reading frame rf2 peptides.
SEQ ID NO: 694 is the amino acid sequence of hPSMA 5' UTR alternative reading frame rf2 peptide A.
SEQ ID NO: 695 is the amino acid sequence of hPSMA 5' UTR alternative reading frame rf2 peptide B.
SEQ ID NO: 696 is the nucleotide sequence of hRCAS1 (Genbank Accession No. AF006265) 5' UTR.
SEQ ID NO: 697 is the amino acid sequence of hRCAS1 5' UTR alternative reading frame rf0 peptides.
SEQ ID NO: 698 is the amino acid sequence of hRCAS1 5' UTR alternative reading frame rf0 peptide A.
SEQ ID NO: 699 is the amino acid sequence of hRCAS1 5' UTR alternative reading frame rf0 peptide B.
SEQ ID NO: 700 is the amino acid sequence of hRCAS1 5' UTR alternative reading frame rf0 peptide C.
SEQ ID NO: 701 is the amino acid sequence of hRCAS1 5' UTR alternative reading frame rf1 peptides.
SEQ ID NO: 702 is the amino acid sequence of hRCAS1 5' UTR alternative reading frame rf1 peptide A.
SEQ ID NO: 703 is the amino acid sequence of hRCAS1 5' UTR alternative reading frame rf1 peptide B.
SEQ ID NO: 704 is the amino acid sequence of hRCAS1 5' UTR alternative reading frame rf1 peptide C.
SEQ ID NO: 705 is the amino acid sequence of hRCAS1 5' UTR alternative reading frame rf2 peptides.
SEQ ID NO: 706 is the amino acid sequence of hRCAS1 5' UTR alternative reading frame rf2 peptide A.
SEQ ID NO: 707 is the amino acid sequence of hRCAS1 5' UTR alternative reading frame rf2 peptide B.
SEQ ID NO: 708 is the nucleotide sequence of hSGA-1M (Genbank Accession No. AY192728) 5' UTR.
SEQ ID NO: 709 is the amino acid sequence of hSGA-1M 5' UTR alternative reading frame rf0 peptides.
SEQ ID NO: 710 is the amino acid sequence of hSGA-1M 5' UTR alternative reading frame rf0 peptide A.
SEQ ID NO: 711 is the amino acid sequence of hSGA-1M 5' UTR alternative reading frame rf0 peptide B.
SEQ ID NO: 712 is the amino acid sequence of hSGA-1M 5' UTR alternative reading frame rf1 peptide.
SEQ ID NO: 713 is the amino acid sequence of hSGA-1M 5' UTR alternative reading frame rf2 peptide.
SEQ ID NO: 714 is the nucleotide sequence of hTERT (Genbank Accession No. NM_003219) 5' UTR.
SEQ ID NO: 715 is the amino acid sequence of hTERT 5' UTR alternative reading frame rf0 peptide.
SEQ ID NO: 716 is the amino acid sequence of hTERT 5' UTR alternative reading frame rf1 peptide.
SEQ ID NO: 717 is the amino acid sequence of hTERT 5' UTR alternative reading frame rf2 peptide.
SEQ ID NO: 718 is the nucleotide sequence of hTRP-P8 (Genbank Accession No. NM_024080) 5' UTR.
SEQ ID NO: 719 is the amino acid sequence of hTRP-P8 5' UTR alternative reading frame rf0 peptides.
SEQ ID NO: 720 is the amino acid sequence of hTRP-P8 5' UTR alternative reading frame rf0 peptide A.
SEQ ID NO: 721 is the amino acid sequence of hTRP-P8 5' UTR alternative reading frame rf1 peptides.
SEQ ID NO: 722 is the amino acid sequence of hTRP-P8 5' UTR alternative reading frame rf2 peptide.
SEQ ID NO: 723 is the nucleotide sequence of hWTI (Genbank Accession No. NM_000378) 5' UTR.
SEQ ID NO: 724 is the amino acid sequence of hWTI 5' UTR alternative reading frame rf0 peptide.
SEQ ID NO: 725 is the amino acid sequence of hWTI 5' UTR alternative reading frame rf1 peptides.
SEQ ID NO: 726 is the amino acid sequence of hWTI 5' UTR alternative reading frame rf1 peptide A.
SEQ ID NO: 727 is the amino acid sequence of hWTI 5' UTR alternative reading frame rf1 peptide B.
SEQ ID NO: 728 is the amino acid sequence of hWTI 5' UTR alternative reading frame rf2 peptides.
SEQ ID NO: 729 is the amino acid sequence of hWTI 5' UTR alternative reading frame rf2 peptide A.
SEQ ID NO: 730 is the amino acid sequence of hWTI 5' UTR alternative reading frame rf2 peptide B.
SEQ ID NO: 731 is the nucleotide sequence of human adenovirus 2 (AD2; Genbank Accession No. BK000407) available as ATCC No. VR-846.
SEQ ID NO: 732 is the nucleotide sequence of human adenovirus 5 (AD5; Genbank Accession No. BK000408) available as ATCC No. VR-5.
SEQ ID NO: 733 is the nucleotide sequence of human adenovirus 11 (AD11; Genbank Accession No. BK001453) available as ATCC No. VR-12.

DETAILED DESCRIPTION OF THE INVENTION

The present invention is based upon the observation that alternative reading frame (ARF) polypeptides resulting from the aberrant expression of proteins are capable of stimulating $CD8^+$ cytotoxic T-cell immune responses. When administered in vivo to an animal, ARF polypeptides or antigen presenting cells (APCs) primed with such ARF polypeptides are effective in reducing the growth of tumor cells and, accordingly, in increasing survival of the animal.

The practice of the present invention will employ, unless indicated specifically to the contrary, conventional methods of virology, immunology, microbiology, molecular biology and recombinant DNA techniques within the skill of the art, many of which are described below for the purpose of illustration. Such techniques are explained fully in the literature. See, e.g., Sambrook, et al., "Molecular Cloning: A Laboratory Manual" (2nd Edition, 1989); "DNA Cloning: A Practical Approach, vol. I & II" (D. Glover, ed.); "Oligonucleotide Synthesis" (N. Gait, ed., 1984); "Nucleic Acid Hybridization" (B. Hames & S. Higgins, eds., 1985); "Transcription and Translation" (B. Hames & S. Higgins, eds., 1984); "Animal Cell Culture" (R. Freshney, ed., 1986); and Perbal, "A Practical Guide to Molecular Cloning" (1984). All publications, patents and patent applications cited herein, whether supra or infra, are hereby incorporated by reference in their entirety.

As used herein, the singular forms "a," "an" and "the" include plural references unless the content clearly dictates otherwise.

As used herein, the term "polynucleotide" is used generically to include all polymers of two or more nucleotides and is meant to include "mRNA," "cDNA" and "DNA."

As used herein, the term "junk DNA" refers to the majority of the genome that is represented by repetitive sequences (about 50%) and noncoding unique sequences. The term "junk DNA" is used herein in a manner consistent with conventional usage in the art and as defined within the following publications which are incorporated herein by reference in their entirety: Zuckerkandl, *Gene* 205(1-2):323-43 (1997); Makalowski, *Acta Biochim. Pol.* 48(3):587-98 (2001); and Elder et al., *Q. Rev. Biol.* 70(3):297-320 (1995).

As used herein, the term "polypeptide" is used generically to include all polymers of two or more amino acids and is meant to include proteins.

In general, ARF polypeptides (including ARF polypeptide fusion proteins and conjugates) and polynucleotides as described herein are isolated. An "isolated" polypeptide or polynucleotide is one that is removed from its original environment. For example, an ARF polypeptide, fusion protein, or conjugate is "isolated" if it is separated from some or all of the coexisting materials in the natural system. Preferably, such polypeptides are at least about 90% pure, more preferably at least about 95% pure and most preferably at least about 99% pure. A polynucleotide is considered to be isolated if, for example, it is cloned into a vector that is not a part of the natural environment.

Alternative Reading Frame Polypeptides

The present invention provides alternative reading frame (ARF) polypeptides derived from the aberrant translation of mRNA or infectious disease antigens. The term "alternative reading frame polypeptide" includes translation products resulting from initiation of translation at a site that is distinct from the site of normal translation initiation. As used herein, two of the possible alternative reading frames are referred to as rf1 and rf2 while the normal reading frame is termed rf0. Thus, rf1 defines the reading frame resulting in translation initiating in the frame one nucleotide 3' to the rf0 frame defined by the normal AUG initiation site and rf2 defines the reading frame resulting in translation that initiates in the frame two nucleotides 3' to the rf0 frame defined by the normal AUG initiation site.

As discussed above, ARF polypeptides are produced in vivo as a consequence of errors inherent in protein synthesis. Without wishing to being limited to any specific mechanism of action, ARF polypeptides according to the present invention correspond to polypeptides generated by in vivo translational errors in either the rf1 or rf2 reading frames including: (1) synthesis of polypeptides in reading frames rf0, rf1, and rf2 generated through AUG translation initiation of open reading frames in 5' and 3' untranslated regions (UTRs); (2) frame-shifting of the initiation complex at the normal rf0 AUG codon one base (rf1) or two bases (rf2) forward or one base (rf2) or two bases (rf1) backward; (3) formation of an initiation complex at an AUG codon that is downstream (i.e. 3' to) the normal initiation AUG codon; (4) formation of an initiation complex at an internal ribosome entry sites (IRES) located 3' to the site of normal ribosomal entry; (5) frame shifting of the ribosome through random and programmed frame-shifts from rf0 to rf1 or rf2 reading frames; (6) formation of initiation complexes at rf1 or rf2 codons other than AUG, such as, for example, ACG or CTG; (7) ribosomal skipping of mRNA segments; (8) ribosomal suppression of termination codons and subsequent translational readthrough; (9) synthesis of polypeptides in reading frames rf0, rf1, and rf2 generated through AUG translation initiation of open reading frames (ORFs) in junk DNA; (10) synthesis of polypeptides in reading frames 3, 4, and 5 (i.e. rf3, rf4, and rf5) resulting from the translation of antisense strands of genes that are expressed through transcription from cryptic promoters; and (11) alternative mRNA splice variants wherein an intron encoded polypeptide reads into exon reading frames rf1 or rf2 of a normal gene product.

The present invention contemplates ARF polypeptides derived from any polynucleotide sequence that is normally expressed in a mammalian cell, preferably a human cell, wherein the ARF polypeptide is capable of eliciting an immune response, most commonly a $CD8^+$ cytotoxic T-cell (CTL) response. Within preferred embodiments, the expression of ARF polypeptides of the present invention is modulated by the transformation of normal tissue into diseased state (carcinomas), usually involving the over-expression of ARF polypeptides.

As exemplified herein, antigens include, but are not limited to, the human tyrosine kinase receptor (hHER-2; SEQ ID NO: 2; Genbank Accession No. M11730); the human telomerase reverse transcriptase (hTERT; SEQ ID NO: 4; Genbank Accession No. NM_003219); the mouse telomerase reverse transcriptase (mTERT; SEQ ID NO: 6; Genbank Accession No. NM_009354); the human transient receptor potential cation channel 8 (hTrpP8; SEQ ID NO: 8; Genbank Accession No. NM 024080); one or more of the human prostatic acid phosphatase variants (hPAP; SEQ ID NOs: 10 and 12; Genbank Accession Nos. M34840 and X53605, respectively), the human carbonic anhydrase IX (hCA9; SEQ ID NO: 295; Genbank Accession No. NM_001216); the human carcinoembryonic antigen (hCEA; SEQ ID NO: 302; Genbank Accession No. M17303); human prostate-specific membrane antigen (hPSMA; SEQ ID NO: 345; Genbank Accession No. NM_004476); human prostate-specific antigen (hPSA; SEQ ID NO: 369; Genbank Accession No. M26663); human p53 cellular tumor antigen (hp53; SEQ ID NO: 381; Genbank Accession No. M14695); human P-glycoprotein (hPGY1; SEQ ID NO: 392; Genbank Accession No. M14758); human alpha-fetoprotein (hAFP; SEQ ID NO: 424; Genbank Accession No. NM_001134); human mucin precursor (hMUC1; SEQ ID NO: 441; Genbank Accession No. AF125525); human preferentially expressed antigen of melanoma (hPRAME; SEQ ID NO: 452; Genbank Accession No. U65011); human ephrin receptor (hEPHA3; SEQ ID NO: 468; Genbank Accession No. AF213459); human peptidyl-prolyl isomerase and essential mitotic regulator (hPIN1; SEQ ID NO: 496; Genbank Accession No. U49070); human BASE (hBASE; SEQ ID NO: 504; Genbank Accession No. AY180924); human prostate stem cell antigen (hPSCA; SEQ ID NO: 515; Genbank Accession No. AF043498); human SURVIVIN (hSURVIVIN; SEQ ID NO: 549; Genbank Accession No. AF077350); human WTI (hWTI; SEQ ID NO: 557; Genbank Accession No. NM_000378); human SGA-M1 (hSGA-M1; SEQ ID NO: 566; Genbank Accession No. AY192728); human RCAS1 (hRCAS1; SEQ ID NO: 579; Genbank Accession No. AF006265); and human CYP1B1 (hCYP1B1; SEQ ID NO: 592; Genbank Accession No. NM_000104).

AUG initiated rf1 and rf2 open reading frames encoding polypeptides of nine or more amino-acids (referred to herein as ARF polypeptides) were identified by analysis of cDNAs encoding the following 22 antigens: human tyrosine kinase receptor (hHER-2), mouse telomerase reverse transcriptase (mTERT), human transient receptor potential cation channel 8 (hTrpP8), human prostatic acid phosphatase (hPAP), human carbonic anhydrase IX (hCA9), and human carcinoembryonic antigen (hCEA), human prostate-specific membrane antigen (hPSMA); human prostate-specific antigen (hPSA); human p53 cellular tumor antigen (hp53); human P-glycoprotein (hPGY1); human alpha-fetoprotein (hAFP); human mucin precursor (hMUC1); human preferentially expressed antigen of melanoma (hPRAME); human ephrin receptor (hEPHA3); human peptidyl-prolyl isomerase and essential mitotic regulator (hPIN1); human BASE (hBASE); human prostate stem cell antigen (hPSCA); human SURVIVIN (hSURVIVIN); human WTI (hWTI); human SGA-M1 (hSGA-M1); human RCAS1 (hRCAS1); and human CYP1B1 (hCYP1B1). Each of these ARF polypeptides initiate at an AUG codon, other than the normal AUG initiation codon, at a position 3' to the site of normal translation initiation.

In addition, two open reading frames, those that correspond to nucleotide position 2 and nucleotide position 3 (i.e. reading frames rf1 and rf2, respectively) of the initiating AUG of hHER-2, mTERT, hTrpP8, hPAP, hCA9, hCEA, hPSMA, hPSA, hp53, hPGY1, hAFP, hMUC1, hPRAME, hEPHA3, hPIN1, hBASE, hPSCA, hSURVIVIN; hWTI; hSGA-M1; hRCAS1; and hCYP1B1 were also identified. These ARF polypeptides correspond to translational initiation adjacent to the normal AUG initiation codon, but result from errors in translation initiation whereby ARF polypeptides are produced in either reading frame rf1 or rf2 rather than in the reading frame, rf0, which reading frame corresponds to translation initiation at the normal AUG initiation codon.

Exemplary ARF polypeptides derived from the polynucleotide encoding hHER-2, SEQ ID NO: 2, are disclosed in Example 2, Table 1, and presented herein as SEQ ID NOs: 15-32. SEQ ID NOs: 15 and 16 depict rf1 and rf2 ARF polypeptides, respectively, encoded by reading frames adjacent to the normal AUG initiation codon while SEQ ID NOs: 17-32 depict rf1 and rf2 ARF polypeptides initiating at AUG codons 3' to the normal AUG initiation codon.

Exemplary ARF polypeptides derived from a polynucleotide encoding hTERT, SEQ ID NO: 4, are disclosed in Example 3, Table 3, and presented herein as SEQ ID NOs: 194-202. SEQ ID NOs: 194 and 195 depict rf1 and rf2 ARF polypeptides, respectively, encoded by reading frames adjacent to the normal AUG initiation codon while SEQ ID NOs: 196-202 depict rf1 and rf2 ARF polypeptides initiating at AUG codons 3' to the normal AUG initiation codon.

Exemplary ARF polypeptides derived from the polynucleotide encoding mTERT, SEQ ID NO: 6, are disclosed in Example 3, Table 5, and presented herein as SEQ ID NOs: 96-111. SEQ ID NOs: 96 and 97 depict rf1 and rf2 ARF polypeptides, respectively, encoded by reading frames adjacent to the normal AUG initiation codon while SEQ ID NOs: 98-111 depict rf1 and rf2 ARF polypeptides initiating at AUG codons 3' to the normal AUG initiation codon.

Exemplary ARF polypeptides derived from a polynucleotide encoding hTrpP8, SEQ ID NO: 8, are disclosed in Example 4, Table 6, and presented herein as SEQ ID NOs: 203-219. SEQ ID NOs: 203 and 204 depict rf1 and rf2 ARF polypeptides, respectively, encoded by reading frames adjacent to the normal AUG initiation codon while SEQ ID NOs: 205-219 depict rf1 and rf2 ARF polypeptides initiating at AUG codons 3' to the normal AUG initiation codon.

Exemplary ARF polypeptides derived from a polynucleotide encoding a hPAP variant, SEQ ID NO: 10, are disclosed in Example 5, Table 8, and presented herein as SEQ ID NOs: 248-256. SEQ ID NOs: 248 and 249 depict rf1 and rf2 ARF polypeptides, respectively, encoded by reading frames adjacent to the normal AUG initiation codon while SEQ ID NOs: 250-256 depict rf1 and rf2 ARF polypeptides initiating at AUG codons 3' to the normal AUG initiation codon.

Exemplary ARF polypeptides derived from a polynucleotide encoding an alternative hPAP variant, SEQ ID NO: 12, are disclosed in Example 5, Table 10, and presented herein as SEQ ID NOs: 280-289. SEQ ID NOs: 280 and 281 depict rf1 and rf2 ARF polypeptides, respectively, encoded by reading frames adjacent to the normal AUG initiation codon while SEQ ID NOs: 282-289 depict rf1 and rf2 ARF polypeptides initiating at AUG codons 3' to the normal AUG initiation codon.

Exemplary ARF polypeptides derived from a polynucleotide encoding h CA9, SEQ ID NO: 295, are disclosed in Example 6, Table 11, and presented herein as SEQ ID NOs: 296-300. SEQ ID NOs: 296 and 297 depict rf1 and rf2 ARF polypeptides, respectively, encoded by reading frames adjacent to the normal AUG initiation codon while SEQ ID NOs: 298-300 depict rf1 and rf2 ARF polypeptides initiating at AUG codons 3' to the normal AUG initiation codon.

Exemplary ARF polypeptides derived from a polynucleotide encoding hCEA, SEQ ID NO: 302, are disclosed in Example 7, Table 12, and presented herein as SEQ ID NOs: 303-319. SEQ ID NOs: 303 and 304 depict rf1 and rf2 ARF polypeptides, respectively, encoded by reading frames adjacent to the normal AUG initiation codon while SEQ ID NOs: 305-319 depict rf1 and rf2 ARF polypeptides initiating at AUG codons 3' to the normal AUG initiation codon.

Exemplary ARF polypeptides derived from a polynucleotide encoding hPSMA, SEQ ID NO: 345, are disclosed in Example 8, Table 13, and presented herein as SEQ ID NOs: 350-367. SEQ ID NOs: 350 and 351 depict rf1 and rf2 ARF polypeptides, respectively, encoded by reading frames adjacent to the normal AUG initiation codon while SEQ ID NOs: 352-367 depict rf1 and rf2 ARF polypeptides initiating at AUG codons 3' to the normal AUG initiation codon.

Exemplary ARF polypeptides derived from a polynucleotide encoding hPSA, SEQ ID NO: 369, are disclosed in Example 9, Table 14, and presented herein as SEQ ID NOs: 374-379. SEQ ID NOs: 374 and 375 depict rf1 and rf2 ARF polypeptides, respectively, encoded by reading frames adjacent to the normal AUG initiation codon while SEQ ID NOs: 376-379 depict rf1 and rf2 ARF polypeptides initiating at AUG codons 3' to the normal AUG initiation codon.

Exemplary ARF polypeptides derived from a polynucleotide encoding hp53, SEQ ID NO: 381, are disclosed in Example 10, Table 15, and presented herein as SEQ ID NOs: 386-390. SEQ ID NO: 386 depicts an rf1 ARF polypeptides encoded by a reading frame adjacent to the normal AUG initiation codon while SEQ ID NOs: 387-390 depict rf1 and rf2 ARF polypeptides initiating at AUG codons 3' to the normal AUG initiation codon.

Exemplary ARF polypeptides derived from a polynucleotide encoding hPGY1, SEQ ID NO: 392, are disclosed in Example 11, Table 16, and presented herein as SEQ ID NOs: 397-422. SEQ ID NO: 397 depicts an rf1 ARF polypeptide encoded by a reading frame adjacent to the normal AUG initiation codon while SEQ ID NOs: 398-422 depict rf1 and rf2 ARF polypeptides initiating at AUG codons 3' to the normal AUG initiation codon.

Exemplary ARF polypeptides derived from a polynucleotide encoding hAFP, SEQ ID NO: 424, are disclosed in Example 12, Table 17, and presented herein as SEQ ID NOs: 429-439. SEQ ID NOs: 446 and 447 depict rf1 and rf2 ARF polypeptides, respectively, encoded by reading frames adjacent to the normal AUG initiation codon while SEQ ID NOs: 448-450 depict rf1 and rf2 ARF polypeptides initiating at AUG codons 3' to the normal AUG initiation codon.

Exemplary ARF polypeptides derived from a polynucleotide encoding hPRAME, SEQ ID NO: 452, are disclosed in Example 14, Table 19, and presented herein as SEQ ID NOs: 457-466. SEQ ID NOs: 457 and 458 depict rf1 and rf2 ARF polypeptides, respectively, encoded by reading frames adjacent to the normal AUG initiation codon while SEQ ID NOs: 459-466 depict rf1 and rf2 ARF polypeptides initiating at AUG codons 3' to the normal AUG initiation codon.

Exemplary ARF polypeptides derived from a polynucleotide encoding hEPHA3, SEQ ID NO: 468, are disclosed in Example 15, Table 20, and presented herein as SEQ ID NOs: 473-494. SEQ ID NOs: 473 and 474 depict rf1 and rf2 ARF polypeptides, respectively, encoded by reading frames adjacent to the normal AUG initiation codon while SEQ ID NOs: 475-494 depict rf1 and rf2 ARF polypeptides initiating at AUG codons 3' to the normal AUG initiation codon.

Exemplary ARF polypeptides derived from a polynucleotide encoding hPIN1, SEQ ID NO: 496, are disclosed in Example 16, Table 21, and presented herein as SEQ ID NOs: 501-502 which depict ARF polypeptides encoded by reading frames adjacent to the normal AUG initiation codon.

Exemplary ARF polypeptides derived from a polynucleotide encoding hBASE, SEQ ID NO: 504, are disclosed in Example 17, Table 22, and presented herein as SEQ ID NOs: 509-513. SEQ ID NO: 509 depicts an rf2 ARF polypeptide encoded by a reading frame adjacent to the normal AUG initiation codon while SEQ ID NOs: 510-513 depict rf1 and rf2 ARF polypeptides initiating at AUG codons 3' to the normal AUG initiation codon.

Exemplary ARF polypeptides derived from a polynucleotide encoding hPSCA, SEQ ID NO: 515, are disclosed in Example 18, Table 23, and presented herein as SEQ ID NOs: 520-521. SEQ ID NO: 520 depicts an rf2 ARF polypeptide encoded by a reading frame adjacent to the normal AUG initiation codon while SEQ ID NO: 521 depicts an ARF polypeptide initiating at AUG codons 3' to the normal AUG initiation codon.

Exemplary ARF polypeptides derived from a polynucleotide encoding hSURVIVIN, SEQ ID NO: 549, are disclosed in Example 19, Table 24, and presented herein as SEQ ID NOs: 551-553 and 555. SEQ ID NOs: 551 and 553 depict rf1 ARF polypeptides and SEQ ID NOs: 552 and 555 depict rf2 ARF polypeptides encoded by a reading frame adjacent to the normal AUG initiation codon.

Exemplary ARF polypeptides derived from a polynucleotide encoding h WTI, SEQ ID NO: 557, are disclosed in Example 20, Table 25, and presented herein as SEQ ID NOs: 559-562 and 564. SEQ ID NOs: 560 and 562 depict rf1 ARF polypeptides and SEQ ID NOs: 559, 561, and 564 depict rf2 ARF polypeptides encoded by a reading frame adjacent to the normal AUG initiation codon.

Exemplary ARF polypeptides derived from a polynucleotide encoding hSGA-M1, SEQ ID NO: 566, are disclosed in Example 21, Table 26, and presented herein as SEQ ID NOs: 568-575 and 577. SEQ ID NOs: 568, 570-572, and 575 depict rf1 ARF polypeptides and SEQ ID NOs: 569, 573, 574, and 577 depict rf2 ARF polypeptides encoded by a reading frame adjacent to the normal AUG initiation codon.

Exemplary ARF polypeptides derived from a polynucleotide encoding hRCAS1, SEQ ID NO: 579, are disclosed in Example 22, Table 27, and presented herein as SEQ ID NOs: 581-588 and 590. SEQ ID NOs: 581, 583-585, 587, and 588 depict rf1 ARF and SEQ ID NOs: 582, 586, and 590 depict rf2 ARF polypeptides encoded by a reading frame adjacent to the normal AUG initiation codon.

Exemplary ARF polypeptides derived from a polynucleotide encoding hCYP1B1, SEQ ID NO: 592, are disclosed in Example 23, Table 28, and presented herein as SEQ ID NOs: 594-599. SEQ ID NOs: 594-597, and 599 depict rf1 ARF and SEQ ID NOs: 598 and 601 depict rf2 ARF polypeptides encoded by a reading frame adjacent to the normal AUG initiation codon.

Pools of overlapping peptides corresponding to rf1 and rf2 ARF polypeptides were synthesized and assayed for capacity to elicit an immune response. As disclosed within the Examples herein, polypeptide pools generated a protective dendritic cell (DC)-induced, cytotoxic T-cell mediated immune response against tumors stably expressing either the hHER-2, the mTERT, the hTrpP8 or the hPAP tumor antigen. For example, peptide pools containing peptides corresponding to the two ARFs that begin in the rf1 and rf2 positions of the rf0 AUG suppressed the in vivo growth of HER-2 expressing autologous tumors in mice.

The present invention further contemplates additional ARF polypeptides corresponding to aberrant translation of a polynucleotide of interest. Regardless of the precise polynucleotide from which the ARF polypeptides are derived, it is preferred that ARF polypeptides comprise at least 9 amino acids in length. Certain embodiments provide ARF polypeptides that are at least 10, 11, 12, 13, 14, or 15 amino acids in length. Still further embodiments provide ARF polypeptides that are at least 16, 17, 18, 19, or 20 amino acids in length. Alternative embodiments provide ARF polypeptides that are at least 25, 30, 35, 40, 45, or 50 amino acids in length or that are at least 75, 100, 150, or 200 amino acids in length.

Within other embodiments of the present invention are "full-length" rf1 and rf2 sequences of hCA9, hCEA, hHER2, hPAP, hTERT, hTrpP8, hPSMA, hPSA, hp53, hPGY1, hAFP, hMUC1, hPRAME, hEPHA3, hPIN1, hBASE, hPSCA, hSURVIVIN, hWTI, hSGA-M1, hRCAS1, and hCYP1B1 derived by deleting stop codons (TGA, TAA, and TAG) and by deleting residues between stop codons that encode less than 9 consecutive amino acid residues. Exemplary full-length rf1 and rf2 amino acid sequences of hCA9, hCEA, hHER2, hPAP, hTERT, hTrpP8, hPSMA, hPSA, hp53, hPGY1, hAFP, hMUC1, hPRAME, hEPHA3, hPIN1, hBASE, hPSCA, hSURVIVIN, hWTI, hSGA-M1, hRCAS1, and hCYP1B1 are presented herein as SEQ ID NOs: 320, 322, 324, 326, 328, 330, 332, 334, 336, 338, 340, 342, 346, 348, 370, 372, 382, 384, 393, 395, 425, 427, 442, 444, 453, 455, 469, 471, 497, 499, 505, 507, 516, 518, 554, 556, 562, 564, 575, 577, 588, 590, 599, and 601, respectively and are encoded by the polynucleotides of SEQ ID NOs: 321, 323, 325, 327, 329, 331, 333, 335, 337, 339, 341, 343, 347, 349, 371, 373, 383, 385, 394, 396, 426, 428, 443, 445, 454, 456, 470, 472, 498, 500, 506, 508, 517, 519, 555, 557, 563, 565, 576, 578, 589, 591, 600, and 602 respectively.

Within still further embodiments, the present invention provides alternative reading frame polypeptides encoded by the 5' untranslated regions (UTRs) of the tumor associated antigens (TAAs) presented herein. As used herein, the term 5' untranslated region or 5'-UTR refers to the nucleotide sequence 5' to the AUG codon that is the site of normal translation initiation and 3' to the mRNA cap. Within this region, alternative reading frame polypeptides may be expressed in the rf0, rf1, or rf2 reading frames relative to the start AUG codon. In general any out-of-frame AUG codon in the 5'UTR is a potential source of Arf peptides as long as it codes for more than 8 residues. This can be further expanded to non-AUG initiation codons in the 5'UTR as described above.

5' UTR alternative reading frames were identified in the tumor associated antigens presented herein and are disclosed in table form in Example 24 (Table 29). In general, sequences downstream of the mRNA 5' cap that encode open reading frames encoding 9 or more residues in all three (rf0, rf1, and rf2) reading frames. The rf0 reading frame is included within the context of 5' UTR because short peptides can be made in this reading frame that are not part of the naturally encoded protein. Because the ribosomes are primed to initiate translation, alternative AUG-like codons can serve to initiate translation—a 5' AUG initiation codon is not required.

Polypeptides according to the present invention may be synthesized by conventional polypeptide synthesis methodology. For example, such polypeptides may be synthesized using any of the commercially available solid-phase techniques, such as the Merrifield solid-phase synthesis method, where amino acids are sequentially added to a growing amino acid chain. See Merrifield, *J. Am. Chem. Soc.* 85:2149-2146 (1963). Equipment for automated synthesis of polypeptides is commercially available from suppliers such as Perkin Elmer/ Applied BioSystems Division (Foster City, Calif.), and may be operated according to the manufacturer's instructions.

Alternatively, conventional molecular biology and recombinant DNA methodology may be employed to generate polynucleotides encoding ARF polypeptides. Such methodology are explained fully in the literature. See, e.g., Sambrook et al., Molecular Cloning: A Laboratory Manual (2nd Edition, 1989); Maniatis et al., Molecular Cloning: A Laboratory Manual (1982); DNA Cloning: A Practical Approach, vol. I & II (D. Glover, ed.); Oligonucleotide Synthesis (N. Gait, ed., 1984); Nucleic Acid Hybridization (B. Hames & S. Higgins, eds., 1985); Transcription and Translation (B. Hames & S. Higgins, eds., 1984); Animal Cell Culture (R. Freshney, ed., 1986); Perbal, A Practical Guide to Molecular Cloning (1984). Each of these publications is incorporated by reference in their entirety.

Briefly, DNA sequences encoding ARF polypeptides may be ligated into an appropriate expression vector wherein the expression vector comprises a transcriptional promoter in operable linkage to the polynucleotide encoding the ARF polypeptide and transcription termination signals 3' to the polynucleotide encoding the ARF polypeptide. Suitable expression vectors may also provide translational start sites, Kozak sequences to direct translation initiation, and stop codons to end translation. In addition, preferred expression vectors may also comprise one or more polynucleotide sequences that encode polypeptides, such as His-His-His-His-His-His (SEQ ID NO: 735) or the FLAG® sequence Asp-Tyr-Lys-Asp-Asp-Asp-Asp-Lys (SEQ ID NO: 736) (Sigma-Aldrich, St. Louis, Mo.), which facilitates detection and affinity purification of the ARF polypeptide.

Expression may be achieved in any appropriate host cell that has been transformed or transfected with an expression vector containing a DNA molecule that encodes a recombinant polypeptide. Suitable host cells include prokaryotes, yeast, insect, and higher eukaryotic cells. Preferably, the host cells employed are *E. coli*, yeast, insect, or a mammalian cell line such as COS or CHO. Supernatants from suitable host/ vector systems that secrete recombinant protein or polypeptide into culture media may be applied to a suitable purification matrix such as an affinity matrix or an ion exchange resin. Finally, one or more reverse phase HPLC steps can be employed to further purify a recombinant polypeptide.

Alternative Reading Frame Polypeptide Fusion Proteins and Conjugates

As indicated above, the present invention is further directed to fusion proteins and conjugates that comprise one or more ARF polypeptides. ARF polypeptide fusion proteins and conjugates may include two or more ARF polypeptides, as disclosed herein above. Fusion proteins and conjugates may also include one or more non-ARF polypeptide as discussed further below.

Within certain specific embodiments, a fusion protein may comprise multiple ARF polypeptides as described herein, or may comprise at least one ARF polypeptide as described herein and an unrelated polypeptide, such as a known tumor polypeptide. A fusion partner may, for example, assist in enhancing an immune response, preferably a cytotoxic T-cell response, or may assist in expressing the protein (an expression enhancer) at higher yields than the native recombinant ARF polypeptide. Certain preferred fusion partners are both immunological and expression enhancing fusion partners. Other fusion partners may be selected so as to increase the solubility of the protein or to enable the protein to be targeted to desired intracellular compartments. Still further fusion partners include affinity tags, which facilitate purification of the protein.

Within certain embodiments, fusion proteins and conjugates may employ an N-terminal moiety and a C-terminal moiety wherein the N-terminal moiety includes at least a portion of one or more ARF polypeptide, as described herein above, and the C-terminal moiety may include at least a portion of an "antigen presenting cell binding protein" or, more preferably, a "dendritic cell binding protein." Equally preferred are protein conjugates wherein the C-terminal moiety includes at least a portion of one or more ARF polypeptide and the N-terminal moiety includes at least a portion of an "antigen presenting cell binding protein" or a "dendritic cell binding protein."

The terms "antigen presenting cell binding protein" and "dendritic cell binding protein" refer to any protein for which receptors are expressed on an APC or a DC, respectively. Examples of APC binding proteins and DC binding proteins include, but are not limited to, GM-CSF, IL-1, TNF, IL-4, CD40L, CTLA4, CD28, and FLT-3 ligand.

Thus, "ARF polypeptide fusion proteins and conjugates," as disclosed herein, include covalent complexes formed between the N-terminal moiety and the C-terminal moiety. Protein conjugates between ARF polypeptides and antigen presenting cell binding proteins/dendritic cell binding proteins may be formed either as chemical complexes or as fusion proteins, as discussed in greater detail herein below.

For example, ARF polypeptide fusion proteins and conjugates may comprise an N- or C-terminal moiety including at least about 9 amino acids of one or more ARF polypeptide and a C- or N-terminal moiety including at least a portion of an APC/DC binding protein. Other embodiments provide fusion proteins and conjugates comprising at least 10, 11, 12, 13, 14, or 15 amino acids of one or more ARF polypeptides. Still further embodiments provide fusion proteins and conjugates comprising at least 16, 17, 18, 19, or 20 amino acids of one or more ARF polypeptides. Alternative embodiments provide fusion proteins and conjugates comprising at least 25, 30, 35, 40, 45, or 50 amino acids of one or more ARF polypeptides or comprising at least 75, 100, 150, or 200 amino acids of one or more ARF polypeptides.

APCs primed with ARF polypeptide fusion proteins and conjugates are effective in activating T-cells to produce a cytotoxic cellular response against the ARF polypeptide. The level of T-cell activation achieved by such ARF polypeptide conjugate primed APCs and/or DCs is generally higher than is achieved by APCs exposed exclusively to APC's and/or DCs primed with an ARF polypeptide alone.

Equally suited to the practice of the present invention are ARF polypeptide conjugates, including fusion proteins, comprising sequence variations within the amino acid sequences of the ARF polypeptide moieties. For example, the present invention contemplates protein conjugates wherein the ARF polypeptide moieties are at least 70% identical with any of the amino acid sequences recited in SEQ ID NOs: 15 through 289, 296-300, 303-319, 350-367, 374-379, 386-390, 397-422, 429-439, 446-450, 457-466, 473-494, 501-502, 509-513, 520-521, 551-553 and 555, 559-562 and 564, 568-575 and 577, 581-588 and 590, and 594-599. More preferred are ARF polypeptide moieties that are at least 80%, 90%, 95% and 98% identical to any of the amino acid sequences recited in SEQ ID NOs: 15 through 289, 296-300, 303-319, 350-367, 374-379, 386-390, 397-422, 429-439, 446-450, 457-466, 473-494, 501-502, 509-513, 520-521, 551-553 and 555, 559-562 and 564, 568-575 and 577, 581-588 and 590, and 594-599.

As pointed out above, ARF polypeptide fusion proteins and conjugates may be formed through chemical means, such as by conventional coupling techniques, or as fusion proteins generated by expression of DNA constructs. Methodologies for generating protein conjugates, whether coupled chemically or in the form of fusion proteins, are well known and readily available in the art. For example, the N-terminal and C-terminal moieties can be coupled using a dehydrating agent such as dicyclohexylcarbodiimide (DCCI) to form a peptide bond between the two peptides. Alternatively, linkages may be formed through sulfhydryl groups, epsilon amino groups, carboxyl groups or other reactive groups present in the polypeptides, using commercially available reagents. (Pierce Co., Rockford, Ill.).

Conventional molecular biology and recombinant DNA techniques for generating fusion proteins are explained fully in the literature and are available by reference to the methodologies disclosed herein above for recombinant methodologies for the generation of ARF polypeptides.

Briefly, polynucleotide sequences encoding the N- and C-terminal moieties may be assembled separately, and ligated into an appropriate expression vector. The 3' end of the polynucleotide encoding the N-terminal moiety is ligated, with or without a peptide linker, to the 5' end of the polynucleotide encoding the C-terminal moiety so that the reading frames of the sequences are in phase. This permits translation into a single fusion protein that retains the biological activity of both component polypeptides.

A peptide linker sequence may be employed to separate the N-terminal and C-terminal moieties by a distance sufficient to ensure that each polypeptide properly folds into its native secondary, tertiary, and quaternary structures. Such a peptide linker sequence may be incorporated into the fusion protein or conjugate using standard techniques well known in the art. Suitable peptide linker sequences may be chosen based on the following factors: (1) their ability to adopt a flexible extended conformation; (2) their inability to adopt a secondary structure that could interact with functional amino acids on the ARF polypeptide or APC/DC binding polypeptide; and (3) the lack of hydrophobic or charged residues that might react with the ARF polypeptide or APC/DC binding polypeptide functional amino acids.

Preferred peptide linker sequences contain Gly, Asn and Ser residues. Other near neutral amino acids, such as Thr and Ala may also be used in the linker sequence. Amino acid sequences which may be usefully employed as linkers include those disclosed in Maratea et al., Gene 40:39-46 (1985); Murphy et al., Proc. Natl. Acad. Sci. USA 83:8258-8262 (1986); U.S. Pat. No. 4,935,233; and U.S. Pat. No. 4,751,180. The linker sequence may generally be from 1 to about 50 amino acids in length. Linker sequences are not required when the first and second polypeptides have non-essential N-terminal amino acid regions that can be used to separate the functional domains and prevent steric interference.

As discussed above in reference to the expression of polynucleotides encoding ARF polypeptides, the ligated polynucleotide sequences are operably linked to suitable transcriptional or translational regulatory elements. The regulatory elements responsible for expression of polynucleotides are located only 5' to the polynucleotide sequence encoding the N-terminal moiety. Similarly, stop codons required to end translation and transcription termination signals are only present 3' to the polynucleotide encoding the C-terminal moiety.

Fragments. Derivatives and Variants of ARF Polypeptides, Fusion Proteins, and Conjugates It will be appreciated that ARF polypeptides, fusion proteins, and conjugates according to the present invention encompass fragments, derivatives, and variants thereof so long as the fragments, derivatives, and variants do not substantially affect the functional properties of the ARF polypeptides, conjugates and fusion proteins.

A polypeptide or protein "fragment, derivative, and variant," as used herein, is a polypeptide or protein that differs from a native polypeptide or protein in one or more substitutions, deletions, additions and/or insertions, such that the functional activity of the polypeptide or protein is not substantially diminished. In other words, the ability of a variant to specifically bind to an antigen-presenting cell (APC) and/or a dendritic cell (DC) MHC class I molecule or to be internalized and/or processed by the APC and/or DC may be enhanced or unchanged, relative to the ARF polypeptide, conjugate or fusion protein, or may be diminished by less that 50%, and preferably less than 20%, relative to the native protein, without affecting the efficacy of the resulting ARF polypeptide, conjugate or fusion protein. Generally, suitable ARF polypeptide conjugate variants may be characterized by assessing the ability of primed APCs and/or DCs to stimulate an ARF polypeptide specific cytotoxic T-cell response.

As used herein, the term "variant" comprehends nucleotide or amino acid sequences different from the specifically identified sequences, wherein one or more nucleotides or amino acid residues is deleted, substituted, or added. Variants may be naturally occurring allelic variants, or non-naturally occurring variants. Variant sequences (polynucleotide or polypeptide) preferably exhibit at least 70%, more preferably at least 80% or at least 90%, more preferably yet at least 95%, and most preferably, at least 98% identity to a sequence of the present invention. The percentage identity is determined by aligning the two sequences to be compared as described below, determining the number of identical residues in the aligned portion, dividing that number by the total number of residues in the inventive (queried) sequence, and multiplying the result by 100. In addition to exhibiting the recited level of sequence similarity, variant sequences of the present invention preferably exhibit a functionality that is substantially similar to the functionality of the sequence against which the variant is compared.

Variants may contain "conservative amino acid substitutions," defined as a substitution in which one amino acid is substituted for another amino acid that has similar properties, such that the secondary structure and hydropathic nature of the polypeptide is substantially unchanged. Amino acid substitutions may generally be made on the basis of similarity in polarity, charge, solubility, hydrophobicity, hydrophilicity and/or the amphipathic nature of the residues. For example, negatively charged amino acids include aspartic acid and glutamic acid; positively charged amino acids include lysine and arginine; and amino acids with uncharged polar head groups having similar hydrophilicity values include leucine, isoleucine and valine; glycine and alanine; asparagine and glutamine; and serine, threonine, phenylalanine and tyrosine. Other groups of amino acids that may represent conservative changes include: (1) ala, pro, gly, glu, asp, gln, asn, ser, thr; (2) cys, ser, tyr, thr; (3) val, ile, leu, met, ala, phe; (4) lys, arg, his; and (5) phe, tyr, trp, his. A variant may also, or alternatively, contain nonconservative changes.

Functional fragments, derivatives, and variants of a polypeptide may be identified by first preparing fragments of the polypeptide by either chemical or enzymatic digestion of the polypeptide, or by mutation analysis of the polynucleotide that encodes the polypeptide and subsequent expression of the resulting mutant polypeptides. The polypeptide fragments or mutant polypeptides are then tested to determine which portions retain biological activity, using, for example, the representative assays provided below.

Fragments, derivatives, and variants of the inventive polypeptides may also be generated by synthetic or recombinant means. Synthetic polypeptides having fewer than about 100 amino acids, and generally fewer than about 50 amino acids, may be generated using techniques well known to those of ordinary skill in the art. For example, such polypeptides may be synthesized the Merrifield solid-phase synthesis method as discussed above.

Variants may also be prepared using standard mutagenesis techniques, such as oligonucleotide-directed, site-specific mutagenesis. Kunkel, *Proc. Natl. Acad. Sci. USA* 82:488-492 (1985). Sections of polynucleotide sequence may also be removed using standard techniques to permit preparation of truncated polypeptides. Variants may additionally, or alternatively, be modified by, for example, the deletion or addition of amino acids that have minimal influence on the immunogenicity, secondary structure and hydropathic nature of the polypeptide.

Polypeptide fragments, derivatives, and variants preferably exhibit at least about 70%, more preferably at least about 80% or 90% and most preferably at least about 95% or 98% sequence identity to the native polypeptide or protein. Polypeptide sequences may be aligned, and percentages of identical amino acids in a specified region may be determined against another polypeptide, using computer algorithms that are publicly available. The alignment and identity of polypeptide sequences may be examined using the BLASTP algorithm. The BLASTP algorithm is described in Pearson and Lipman, *Proc. Natl. Acad. Sci. USA* 85:2444-2448 (1988); and in Pearson, *Methods in Enzymol.* 183:63-98 (1990).

The BLASTP software is available on the NCBI anonymous FTP server and is available from the National Center for Biotechnology Information (NCBI), National Library of Medicine, Building 38A, Room 8N805, Bethesda, Md. 20894. The BLASTP algorithm Version 2.0.6 [Sep. 10, 1998] and Version 2.0.11 [Jan. 20, 2000] set to the default parameters described in the documentation and distributed with the algorithm, is preferred for use in the determination of variants according to the present invention. The use of the BLAST family of algorithms, including BLASTP, is described at NCBI's website and in the publication of Altschul et al., "Gapped BLAST and PSI-BLAST: a new generation of protein database search programs," *Nucleic Acids Res.* 25:3389-3402 (1997).

The "hits" to one or more database sequences by a queried sequence produced by BLASTP, or a similar algorithm, align and identify similar portions of sequences. The hits are arranged in order of the degree of similarity and the length of sequence overlap. Hits to a database sequence generally represent an overlap over only a fraction of the sequence length of the queried sequence.

The percentage identity of a polypeptide sequence is determined by aligning polypeptide sequences using appropriate algorithms, such as BLASTP, set to default parameters; identifying the number of identical amino acids over the aligned portions; dividing the number of identical amino acids by the total number of amino acids of the polypeptide of the present invention; and then multiplying by 100 to determine the percentage identity.

The BLASTP algorithm also produces "Expect" values for polypeptide alignments. The Expect value (E) indicates the number of hits one can "expect" to see over a certain number of contiguous sequences by chance when searching a database of a certain size. The Expect value is used as a significance threshold for determining whether the hit to a database indicates true similarity. For example, an E value of 0.1 assigned to a polypeptide hit is interpreted as meaning that in a database of the size of the SwissProt database, one might expect to see 0.1 matches over the aligned portion of the sequence with a similar score simply by chance. By this criterion, the aligned and matched portions of the sequences then have a probability of 90% of being related. For sequences having an E value of 0.01 or less over aligned and matched portions, the probability of finding a match by chance in the SwissProt database is 1% or less using the BLASTP algorithm.

According to one embodiment, "variant" ARF polypeptides, with reference to each of ARF polypeptides of the present invention, preferably comprise sequences having the same number or fewer amino acids than each of the ARF polypeptides of the present invention and producing an E value of 0.01 or less when compared to the ARF polypeptide of the present invention.

In addition to having a specified percentage identity to an inventive ARF polypeptide, variant polypeptides preferably have additional structure and/or functional features in common with the inventive ARF polypeptide. Polypeptides having a specified degree of identity to an ARF polypeptide of the present invention share a high degree of similarity in their primary structure and have substantially similar functional properties. In addition to sharing a high degree of similarity in their primary structure to ARF polypeptides of the present invention, polypeptides having a specified degree of identity to, or capable of hybridizing to, an inventive polypeptide preferably have at least one of the following features: (i) they have substantially the same functional properties as an inventive ARF polypeptide; or (ii) they contain identifiable domains in common.

Antigen Presenting Cell- and Dendritic Cell-Based ARF Polypeptide Compositions

As indicated above, within certain embodiments, the present invention provides immunotherapeutic compositions for the treatment of cancers and infectious diseases comprising antigen presenting cells (APCs), including dendritic cells (DCs), primed with one or more ARF polypeptide, conjugate and/or fusion protein. APCs may be primed by exposure ex vivo and/or in vivo to an ARF polypeptide such that the APCs are effective in activating T-cells to produce a cytotoxic T-cell (CTL) response against the ARF polypeptide. APCs may, alternatively or additionally, be primed by exposure ex vivo and/or in vivo to a polynucleotide encoding one or more of the ARF polypeptides and/or fusion proteins presented herein.

As used herein, the term "antigen presenting cells" or "APCs" refers to cells that are capable of activating T-cells, and include, but are not limited to, certain macrophages, B cells, and, most preferably, dendritic cells (DCs). "Potent antigen presenting cells" are cells that, after being pulsed with an ARF polypeptide, conjugate and/or fusion protein, can activate naïve CD8+ cytotoxic T-cells in a primary immune response. "Dendritic cells" or "DCs" are members of a diverse population of morphologically similar cell types found in lymphoid or non-lymphoid tissues. These cells are characterized by their distinctive morphology and high levels of surface MHC-class II expression. Steinman et al., *Ann. Rev. Immunol.* 9:271 (1991), incorporated herein by reference. APCs and DCs can be isolated from a number of tissue sources, and conveniently, from peripheral blood, as described herein. Preferred immunotherapeutic compositions of the present invention employ APCs or DCs that are isolated from a cancer patient and/or a patient afflicted with an infectious disease.

APCs and DCs may be isolated by routine methodologies that are readily available in the art. An exemplary suitable methodology for isolation of DCs is disclosed in U.S. Pat. Nos. 5,976,546, 6,080,409, and 6,210,662. Briefly, buffy coats may be prepared from peripheral blood. Cells may be harvested from leukopacs, layered over columns of organosilanized colloidal silica (OCS) separation medium (prepared as described by Dorn in U.S. Pat. No. 4,927,749, incorporated herein by reference, at a density 1.0770 gr/ml, pH 7.4, 280 mOsm/kg H2O) in centrifuge tubes or devices. The OCS medium is preferably prepared by reacting and thus blocking the silanol groups of colloidal silica (approx. 10-20 nm diameter particles) with an alkyl trimethoxy silane reagent.

Related colloidal silicas and methods for production thereof are disclosed in U.S. Pat. No. 4,927,749 to Dorn. In a preferred embodiment, the OCS density gradient material is diluted to an appropriate specific density in a physiological salt solution supplemented with polyvinylpyrrolidone (PVP) such as PVP-10 available from Sigma Chemical Co. (St. Louis, Mo.). The tubes are centrifuged and the peripheral blood mononuclear cells (PBMC), present at the interface, are harvested.

PBMC are resuspended and centrifuged again to remove platelets and may optionally be spun through columns of OCS (density 1.0650 gr/ml, 280 mOsm/kg H2O). The resulting interface and pellet cells are harvested and washed with D-PBS by centrifugation. The pellet fraction is resuspended in cell culture medium and cultured in a humidified 5% CO2 incubator for 40 hours. Following incubation, the non adherent cells are harvested. The purity of dendritic cells in the interface fraction may be quantified by FACS analysis.

The morphology of the cells can be evaluated using photomicroscopy. The DC enriched fraction contains large sized veiled cells with cytoplasmic processes extending from the cell surface, features characteristic of DC.

Cell surface phenotypic analysis may also be carried out through flow cytometric methodology. For example, samples consisting of approximately $1-3\times10^7$ cells may be incubated in 10% normal mouse serum in PBS for 10 min., washed in PBS, and resuspended in 250-750 µl PBS. The cell suspension may then dispensed at 30 µl/well into round-bottom 96-well plates. FITC-, PE-, and PerCP-conjugated mAb are then added at 10 µl/well and cells incubated for 20 min. in the dark on ice. Cells are then washed with 200 µl/well of PBS and resuspended in 400 µl/well in PBS, then analyzed by FACScan (Becton Dickinson) using cells labeled with isotype-matched control Ab as a negative control. Preferred functional characteristics of mature DCs include the acquisition of allostimulatory and Ag-presenting abilities.

Within certain embodiments, APCs and DCs are primed with one or more ARF polypeptides, fusion proteins and/or conjugates described herein above. Generally, ARF polypeptides, fusion proteins and/or conjugates are applied in any combination repeatedly or in a sequential manner such that the primed DC are effective in presenting antigen in the context of MHC class I. Within such embodiments, ARF polypeptide primed DC are capable of processing the immunogenic ARF polypeptide through the "endogenous" class I pathway such that antigens are presented in association with MHC class I molecules, and accordingly are able to activate CD8+ CTL.

Enriched DC may be resuspended in RPMI media at a concentration of approximately $10^6$ cells/ml, incubated in the presence of one or more ARF polypeptide, fusion protein and/or conjugate at a concentration of approximately 50 µg/ml for 4-5 hours or overnight in a humidified 37° C. incubator with 5% $CO_2$.

Primed DC are generally washed of free ARF polypeptide, fusion protein, and/or conjugate with injection grade saline and resuspended into a volume of approximately 100 ml in an intravaneous injection administration bag. It will be understood that, depending on the precise treatment regimen contemplated, ARF polypeptide primed DC may be administered parenterally (e.g., intravenously (IV)), subcutaneously (SC), intraperitoneally (IP), and intramuscularly (IM).

For example, in the case of IV administration, patients may be premedicated with acetaminophen and diphenhydramine and administered the ARF polypeptide primed DC through a peripheral intravenous line or a central catheter over a period of 30-60 minutes. Generally, primed APC are administered at regular intervals for a short time period, e.g., in bi-weekly intervals for two months or less. Depending on the precise application, patients may receive 1, 2, 3, or 4 additional similar preparations of ARF polypeptide, fusion protein, and/or conjugate primed DC.

In one aspect of this embodiment, the ARF polypeptide primed DC comprises from approximately $10^7$ to approximately $10^{11}$ DC, which have been exposed to from about 100 ng/ml to 1 mg/ml of a given ARF polypeptide, in a manner effective to generate Ag-loaded DC. Doses of about $10^7$ to $10^{11}$ DC are then administered to the patient by IV, SC or IM injection according to established procedures for a short time period, e.g., at bi-weekly intervals for 2 months or less. In some cases, however, the ARF polypeptide primed DC is administered intermittently over a longer period of time.

Within alternative embodiments, polynucleotides encoding one or more ARF polypeptides and/or fusion proteins may be introduced into APCs and DCs thereby permitting the expression of the respective ARF polypeptide and/or fusion protein. Thus, DNA encoding an ARF polypeptide or fusion protein may be cloned into a suitable expression vector and the APC or DC transfected with the resulting expression construct such that the ARF polypeptide or fusion protein is expressed in association with class I MHC.

Any of a variety of known methodology may be used for such transfections including, but not limited to, $CaPO_4$ precipitation, lipofection, naked DNA exposure, as well as viral vector-based approaches, such as retroviral, adenoviral, AAV, and vaccinia virus vectors. See, for example, Ausubel et al., "Current Protocols in Molecular Biology" (J. Wiley and Sons, Inc.) and Mulligan, *Science* 260(5110):926-32 (1993). Suitable exemplary viral vector systems are described in detail herein below.

By still further embodiments of the present invention, ARF polypeptides, fusion proteins and/or conjugates and polynucleotides encoding ARF polypeptides, fusion proteins and/or conjugates may be administered directly to a mammal, including a human, to achieve in vivo APC/DC priming. For example, one or more ARF polypeptide or polynucleotide may be injected directly into a human patient in a manner effective to induce cell-surface presentation of the immunogenic component of the ARF polypeptide.

Typically, one or more doses of the ARF polypeptide, fusion protein and/or conjugate is administered, generally at bi-weekly intervals for a period of about two months. Preferred doses for administration by the IV, SC or IM route are from about 5 μg/kg per patient to about 5 mg/kg per patient. ARF polypeptides, fusion proteins and/or conjugates are most commonly administered in conjunction with a pharmaceutically acceptable carrier or excipient including, but not limited to, saline, phosphate buffered saline (PBS), water and Ringer's solution. It will be understood that the choice of suitable physiologically acceptable carrier or excipient will vary depending upon the chosen mode of administration.

Regardless of the precise mode of administration, systemic reaction to the administration procedure should be carefully monitored. For example, systemic reactions may be scored for temperature, blood pressure, and signs of bronchospasm, vasculitis, and/or immune complex formation. The risk of anaphylaxis is, however, extremely low with the use of autologous cells.

Viral Vector Systems for Administration of Polynucleotides Encoding ARF Polypeptides and Fusion Proteins As disclosed herein, polynucleotides encoding one or more ARF polypeptide and/or fusion protein may be cloned into an expression vector, such as a viral vector, to permit ex vivo administration to APCs and/or in vivo administration to a mammal, such as a human. Suitable vector systems for introducing such polynucleotides into APC include, but are not limited to adenovirus-, retrovirus-, and adeno-associated virus-based expression vectors. Alternatively one of a wide variety of commercially available non-viral expression vector systems may be employed.

Thus, within certain embodiments, administration of one or more polynucleotides may be achieved through the use of an adenovirus-based expression vector. As used herein, the phrase "adenovirus-based expression vector" is meant to include those expression vector constructs containing adenovirus sequences that are sufficient to (a) support packaging of the construct and (b) permit expression of a cloned ARF polynucleotide.

Viruses provide an efficient means for delivering DNA into the nucleus of a cell. Furthermore, class I presentation of antigenic peptides is inherent in virus mediated DNA delivery. Replication incompetent viruses bind the surface of the target cell and are readily engulfed by the cell.

The present invention contemplates the use of adenovirus vectors encoding one or more antigen transcriptional units using constitutive promoters such as CMV where the preferred antigens include TAA encoded Arf antigens presented herein above. Thus, adenoviral vectors as described herein may be engineered to encode fusions of one or more of the tumor associated antigen 5' UTR- and/or structural gene-encoding ARF polypeptide sequences presented herein. Transcriptional units in the adenovirus, whose promoter function is restricted to APCs, may be suitably employed for the appropriate cell specific expression of the ARF, ARF fusion protein, and/or ARF conjugate of the present invention. For example, the human fascin gene promoter may be used to facilitate transcriptional targeting of mature DC because fascin expression is required for dendritic cell maturation. Bros et al., *J. Immunol.* 171:1825-1834 (2003). Adenoviruses may be used as a protein or a DNA delivery vehicle by making benign fusion proteins between adenovirus coat proteins and target antigen. Within such an embodiment, the virus would carry both the DNA encoding target antigen and protein antigens itself.

Adenovirus-based expression vectors are generally genetically engineered forms of the 36 kb, linear, double-stranded DNA virus. Conventional adenovirus vectors permit the substitution of up to 7 kb fragments of adenoviral DNA with non-adenoviral polynucleotide sequences. Adenoviruses can infect virtually all cells regardless of their cell cycle stage; the infection of host cells does not result in chromosomal integration because adenoviral DNA can replicate in an episomal manner without potential genotoxicity.

Adenovirus with serotype-11 or -35 knob-protein will bind human $CD46^+$ cells and deposit their DNA in the nucleus. CD46 is found on the surface of APC cells. The loading capacity of the viral backbone for exogenous DNA is greater than 8000 nucleotides, enough for several transcriptional units. Viral hybrids of adenovirus serotype-2 backbone with adenovirus serotype-11 knob-protein may be constructed and used to introduce genes encoding antigens to $CD46^+$ APC cells ex vivo. Such ex vivo administration of ARF encoding DNA sequences may be advantageously employed to avoid a neutralizing humoral response to subsequent adenovirus vaccinations. The polynucleotide sequences of human adenoviruses of serotypes 2, 5, and 11 are presented herein as SEQ ID NOs: 731, 732, and 733, respectively.

Both ends of the adenoviral genome contain 100-200 base pair inverted repeats (ITRs), which are cis elements necessary for viral DNA replication and packaging. The early (E) and late (L) regions of the genome contain different transcription units that are divided by the onset of viral DNA replication. The E1 region (E1A and E1B) encodes proteins responsible for the regulation of transcription of the viral genome and a few cellular genes. Expression of the E2 region (E2A and E2B) results in the synthesis of the proteins for viral DNA replication. These proteins are involved in DNA replication, late gene expression and host cell shut-off. Renan, Radiother Oncol. 19(3):197-218 (1990).

The products of the late genes, including the majority of the viral capsid proteins, are expressed only after significant processing of a single primary transcript issued by the major late promoter (MLP). The MLP, (located at 16.8 m.u.) is particularly efficient during the late phase of infection, and all the mRNA's issued from this promoter possess a 5'-tripartite leader (TPL) sequence which makes them preferred mRNA's for translation.

Generation and propagation of the current adenovirus vectors, which are replication deficient, depend on a unique helper cell line, designated 293, which was transformed from human embryonic kidney cells by Ad5 DNA fragments and constitutively expresses E1 proteins. Graham, Adv Cancer Res. 25:1-51 (1977). Since the E3 region is dispensable from the adenovirus genome, current adenovirus vectors, with the help of 293 cells, carry foreign DNA in either the E1, the E3, or both regions. Jones et al., Cell 13(10):181-8 (1978) and Graham et al., Mol Biotechnol. 3(3):207-20. (1995).

Helper cell lines may be derived from human cells such as human embryonic kidney cells, muscle cells, hematopoietic cells or other human embryonic mesenchymal or epithelial cells. Alternatively, the helper cells may be derived from the cells of other mammalian species that are permissive for human adenovirus. Such cells include, e.g., Vero cells or other monkey embryonic mesenchymal or epithelial cells. The currently preferred helper cell line is 293.

The adenovirus may be of any of the 42 different known serotypes or subgroups A-F. Adenovirus type 5 of subgroup C is the preferred starting material in order to obtain the conditional replication-defective adenovirus vector for use in the present invention.

Preferred adenovirus-based expression vectors according to the present invention are replication defective and are deleted in the E1 region. Generally, but not necessarily, an ARF polypeptide and/or fusion protein encoding polynucleotide may be cloned into the adenovirus vector within the region of the deleted E1-coding sequence. The polynucleotide encoding the ARF polypeptide and/or fusion protein may, alternatively, be inserted in lieu of the deleted E3 or E4 regions. See, e.g., Karlsson et al., *EMBO J.* 5(9):2377-85 (1986).

Within other embodiments, the present invention provides retroviral-based expression vectors for the ex vivo and in vivo expression of polynucleotides encoding ARF polypeptide and/or fusion proteins. Retroviruses are a group of single-stranded RNA viruses characterized by an ability to convert their RNA to double-stranded DNA in infected cells by a process of reverse-transcription. Coffin, *Curr. Top. Microbiol. Immunol.* 176:143-64 (1992). The resulting DNA then stably integrates into cellular chromosomes as a provirus and directs synthesis of viral proteins. Integration results in the retention of the viral gene sequences in the recipient cell and its descendants.

Retroviral genomes contain three genes, gag, pol, and env that code for capsid proteins, polymerase enzyme, and envelope components, respectively. A sequence found upstream from the gag gene contains a signal for packaging of the genome into virions. Two long terminal repeat (LTR) sequences are present at the 5' and 3' ends of the viral genome. These contain strong promoter and enhancer sequences and are also required for integration in the host cell genome. Id.

Retroviral-based expression vectors of the present invention comprise a polynucleotide encoding one or more ARF polypeptide and/or fusion protein as described herein above. A polynucleotide(s) is inserted into the viral genome in place of viral sequences required for viral that is replication-defective. In order to produce virions, a packaging cell line containing the gag, pol, and env genes but without the LTR and packaging components is employed. Mann et al., *Cell* 33(1):153-9 (1983). Upon introduction of a retroviral-based vector into a suitable packaging cell line (such as by $CaPO_4$ precipitation), a packaging sequence facilitates packaging of the RNA transcript into viral particles, which are then secreted into the culture media. Nicolas et al., *Biotechnology* 10:493-513 (1988); Temin, *Cell Biophys.* 9(1-2):9-16. (1986); and Mann et al., supra. Media containing the recombinant retrovirus is collected, concentrated, and administered either ex vivo to dividing APC and/or DC or in vivo to a mammal, such as a human.

Still further embodiments of the present invention employ adeno-associated viruses to achieve ex vivo and/or in vivo expression of one or more polynucleotide encoding an ARF polypeptide and/or fusion protein and described herein above. Adeno-associated virus (AAV) is a parovirus, discovered as a contamination of adenoviral stocks. Hermonat et al., *Proc Natl Acad Sci USA.* 81(20):6466-70 (1984). Five serotypes have been isolated, of which AAV-2 is the best characterized. AAV has a single-stranded linear DNA that is encapsidated into capsid proteins VP1, VP2 and VP3 to form an icosahedral virion of 20 to 24 nm in diameter. McLaughlin et al., *J. Virol.* 62(6):1963-73 (1988).

The AAV DNA is approximately 4.7 kilobases long, contains two open reading frames (rep and cap), and is flanked by two ITRs. The rep gene encodes proteins responsible for viral replication and cap encodes capsid protein VP1-3. Each ITR forms a T-shaped hairpin structure and are the only essential cis components of the AAV for chromosomal integration. Thus, the AAV can be used as a vector with all viral coding sequences removed and replaced by the cassette of genes for delivery.

Three viral promoters have been identified and named p5, p19, and p40, according to their map position. Transcription from p5 and p19 results in production of rep proteins, and transcription from p40 produces the capsid proteins. Hermonat et al., supra.

Other viral vector expression systems may be suitably employed for the ex vivo and in vivo expression of polynucleotides encoding ARF polypeptides and fusion proteins in APC and/or DC. For example, vectors derived from viruses such as vaccinia virus, lentiviruses, polio viruses and herpesviruses may be employed. The hepatitis B virus retains the capacity for helper-dependent packaging and reverse transcription despite the deletion of up to 80% of its genome. Horwich et al., *J. Virol.* 64(2):642-50 (1990). This suggests that large portions of the genome can be replaced with foreign genetic material.

Immunotherapeutic Methods

As indicated above, within certain embodiments, the present invention provides methods for identifying ARF polypeptides capable of stimulating an immune response. By these methods, an antigen of interest is selected wherein the antigen is encoded by a polynucleotide; rf1 and/or rf2 alternative reading frame polypeptides encoded by the polynucleotide are identified; and polypeptides encoded by the rf1 and rf2 reading frames are synthesized. Antigen presenting cells (APCs) are primed with each of the ARF polypeptides to be tested and the primed APCs contacted with naïve cytotoxic T-cells (CTLs) to produce a population of activated CTLs. The population of CTLs are contacted with cells expressing the antigen of interest to test for an ARF polypeptide-specific cytotoxic T-cell response. Lysis of the antigen expressing cell by the activated CTLs indicates that the ARF polypeptide is capable of stimulating an immune response.

Within other embodiments, the present invention further provides methods for eliciting an immune response in a patient and for inhibiting proliferation of a tumor cell in a cancer patient. By these methods, a sample containing antigen presenting cells (APCs) is obtained, the APCs isolated, and primed ex vivo with one or more ARF polypeptide, conjugate and/or fusion protein. The primed APCs are administered to a patient in order to stimulate an in vivo immune response.

Related methods are provided for inhibiting proliferation of a tumor cell in a cancer patient. These methods comprise the steps of obtaining from the cancer patient a sample containing antigen presenting cells (APCs) and isolating the APCs from the sample. The isolated APCs may be primed ex vivo with an ARF polypeptide, conjugate and/or fusion protein such that the primed APCs are capable of stimulating an immune response in vivo. The primed APCs are administered to the cancer thereby inhibiting proliferation of the tumor cell.

Within preferred embodiments, the immune response is a cytotoxic T-cell response wherein the cytotoxic T-cell response is directed specifically against a tumor cell. Specific preferred embodiments provide that the APCs are dendritic cells (DCs).

Within preferred methods, the tumor cell is isolated from a patient afflicted with a cancer such as, for example, a soft tissue sarcoma, a lymphoma, and/or a cancer of the brain, esophagus, uterus, cervix, bone, lung, endometrium, bladder, breast, larynx, colon/rectum, stomach, ovary, pancreas, adrenal gland and prostate. Tumor cells may be obtained from patients afflicted with other cancers as well.

The following Examples are offered by way of illustration and not limitation.

EXAMPLE 1

Synthesis of Alternative Reading Frame Polypeptides

All polypeptides disclosed herein were synthesized by Genemed Synthesis, Inc. (South San Francisco, Calif.). Mass spectrophotometric analysis and C-18 reverse phase chromatography were used to confirm each peptide's molecular weight and to test the chemical uniformity of each polypeptide, respectively. For all polypeptide pools, equal weights of each lyophilized polypeptide were combined in each pool and the pooled polypeptides were dissolved in dimethyl formamide (DMF) at a concentration of 1 mM (assuming equivalent molecular weights).

EXAMPLE 2

Human HER-2 Alternative Reading Frame Polypeptides

This example discloses alternative reading frame (ARF) polypeptides that were designed and synthesized based on the polynucleotide presented herein as SEQ ID NO: 2 (Genbank Accession No. M11730) that encodes the amino acid sequence of the human tyrosine kinase receptor (hHER-2) presented herein as SEQ ID NO: 1.

The hHER-2 polynucleotide sequence was analyzed for alternative reading frames encoding AUG initiated polypeptides of equal to or greater than 9 amino acids where the AUG is downstream of (i.e. 3' to) the AUG utilized for normal translation initiation. Fifteen ARF polypeptides were identified wherein an AUG sequence is within the rf1 or rf2 reading frame. In addition, the two polypeptides corresponding to reading frames rf1 and rf2 that initiate one and two nucleotides downstream, respectively, of the normal rf0 AUG initiation site were also included. In total, thirteen of these ARF polypeptides are within the rf1 reading frame and four of these ARF polypeptides are within the rf2 reading frame. Overlapping polypeptides encompassing these 17 ARF polypeptides are presented in Table 1.

Pool A comprises 32 polypeptides, designated as polypeptides 203 through 3431C, having an average length of twenty-three residues. Overlapping polypeptides were synthesized such that these 32 polypeptides encompass the fifteen rf1 and rf2 AUG-initiated alternative reading frames.

Pool B comprises 31 polypeptides, designated 2A through 3Y, having an average length of fifteen residues. Overlapping polypeptides were synthesized such that these 31 polypeptides encompass the two ARF open reading frames (i.e. a twenty-nine residue 2:91 rf1-2 polypeptide and a 107 residue 2:323 rf2-3 polypeptide). The rf1 and rf2 polypeptides initiate at position two and position three of the HER-2 rf0 AUG, respectively, where the rf0 HER-2 'A' of AUG defines position one.

Pool B was further subdivided into two pools, Pool B2 and Pool B3. Pool B2 comprises six overlapping peptides, designated 2A through 2F, which correspond to the 2:91 rf1-2 ARF open reading frame. Pool B3 comprises twenty-five overlapping peptides, designated 3A through 3Y, which corresponds to the 3:323 rf2-3 ARF open reading frame.

TABLE 1

Human HER-2 Alternative Reading Frame Polypeptides (Derived from the hHER-2 polynucleotide sequence presented herein as SEQ ID NO: 2, Genbank Accession No. M11730)

| Sequence | SEQ ID NO: |
|---|---|
| APWSWRPCAAGGSSSPSCPPEPRAP KCAPAQT | 15 |
| ARPPPLAAPRNPRAPSRVQPEPWGR SRSEHHGAGGLVPLGAPPRPLAPRS REHPSVHRHRHEAAAPCQSRDPPG HAPPPLPGLPGGAGKPGTHLPAHQ CQPVLPAGYPGGAGLRAHRSQPSE AGPTAEAADCARHPAL | 16 |
| MPACPSCRISRRCRATCSSLTTK | 17 |
| MSSVLPAARAPSTLTAWPASTSTTV ASVSCTAQPWSPTTQTRLSPCPIPRA GIHSAPAV | 18 |
| MEHSGVRSAASPVPECAMVWAWS TCER | 19 |
| MGTQPPTLPRSSQSSSKCLRLWKRS QVTYTSQHGRTACLTSASSRTCK | 20 |
| MPSTAGAPQGVCECQALFAVPP | 21 |
| MPGTVCRATLSVSPRMAQ | 22 |
| MRRAHASLAPSTAPTPVWTWMTR AAPPSREPAL | 23 |
| MPALPHQLHPLLCGPG | 24 |
| MSPAFWASA | 25 |
| MSGKTADAWAPRTC | 26 |
| MCGSYTGTWPLGTCWSRVPTMSK LQTSGWLGCWTLTRQSTMQMGAR CPSSGWRWSPFSAGGSPTRVMCGV MV | 27 |
| MGSQPGRSLTCWKRGSGCPSPPSA PLMST | 28 |
| MSAKIPGVGV | 29 |
| MRTWAQPVPWTAPSTAHCWRTM TWGTWWMLRSIWYPSRASSVQTL PRALGAWSTTGTAAHLPGVAVGT MYLMVTWEWGQPRGCKASPHMT PALYSGTVRTPQYPCPLRLMATLPP | 30 |
| MFGPSPLRPERALCLLPDLLVPLWK GPRLSPQGRMGSSKTFLPLGVPWR TPS | 31 |
| | 32 |

TABLE 2

Human HER-2 Alternative Reading Frame Polypeptide Pools (Designed based upon the hHER-2 ARF polypeptides presented in Table 1)

| Identifier | Sequence | SEQ ID NO: |
|---|---|---|
| | Pool A | |
| 203 | MPACPSCRISRRCRATCSSLTTK | 33 |
| 710A | MSSVLPAARAPSTLTAWPASTST | 34 |
| 710B | TAWPASTSTTVASVSCTAQPWSP | 35 |
| 710C | VSCTAQPWSPTTQTRLSPCPIP | 36 |
| 710D | QTRLSPCPIPRAGIHSAPAV | 37 |
| 977 | MEHSGVRSAASPVPECAMVWAWSTCER | 38 |
| 1145A | MGTQPPTLPRSSQSSSKCLRLWK | 39 |
| 1145B | SSSKCLRLWKRSQVTYTSQHGRT | 40 |
| 1145C | VTYTSQHGRTACLTSASSRTCK | 41 |
| 1629 | MPSTAGAPQGVCECQALFAVPP | 42 |
| 1667 | MPGTVCRATLSVSPRMAQ | 43 |
| 1853A | MRRAHASLAPSTAPTPVWTWMT | 44 |
| 1853B | APTPVWTWMTRAAPPSREPAL | 45 |
| 1866 | MPALPHQLHPLLCGPG | 46 |
| 2426 | MSGKTADAWAPRTC | 47 |
| 2513A | MCGSYTGTWPLGTCWSRVPTMSK | 48 |
| 2513B | CWSRVPTMSKLQTSGWLGCWTLT | 49 |
| 2513C | SGWLGCWTLTRQSTMQMGARCPS | 50 |
| 2513D | TMQMGARCPSSGWRWSPFSAGGS | 51 |

TABLE 2-continued

Human HER-2 Alternative Reading Frame Polypeptide Pools (Designed based upon the hHER-2 ARF polypeptides presented in Table 1)

| Identifier | Sequence | SEQ ID NO: |
|---|---|---|
| 2513E | RWSPFSAGGSPTRVMCGVMV | 52 |
| 2771 | MGSQPGRSLTCWKRGSGCPSPPSAPLMST | 53 |
| 2892 | MSAKIPGVGV | 54 |
| 2972A | MRTWAQPVWTAPSTAHCWRTMTWG | 55 |
| 2972B | AHCWRTMTWGTWWMLRSIWYPSRA | 56 |
| 2972C | LRSIWYPSRASSVQTLPRALGAWS | 57 |
| 2972D | TLPRALGAWSTTGTAAHLPGVAVGT | 58 |
| 3251A | MYLMVTWEWGQPRGCKASPHMTPA | 59 |
| 3251B | CKASPHMTPALYSGTVRTPQYPCP | 60 |
| 3251C | TVRTPQYPCPLRLMATLPP | 61 |
| 3431A | MFGPSPLRPERALCLLPDLLVPLWK | 62 |
| 3431B | LPDLLVPLWKGPRLSPQGRMGSSKT | 63 |
| 3431C | PQGRMGSSKTFLPLGVPWRTPST | 64 |
| Pool B | | |
| Pool B2 | | |
| 2A | WSWRPCAAGGSSSPS | 65 |
| 2B | PCAAGGSSSPSCPPE | 66 |
| 2C | GGSSSPSCPPEPRAP | 67 |
| 2D | SPSCPPEPRAPKCAP | 68 |
| 2E | PPEPRAPKCAPAQT | 69 |
| 2F | RAPKCAPAQT | 70 |
| Pool B3 | | |
| 3A | GAGGLVPLGAPPRPL | 71 |
| 3B | LVPLGAPPRPLAPRS | 72 |
| 3C | GAPPRPLAPRSREHP | 73 |
| 3D | RPLAPRSREHPSVHR | 74 |
| 3E | PRSREHPSVHRHRHE | 75 |
| 3F | EHPSVHRHRHEAAAP | 76 |
| 3G | VHRHRHEAAAPCQSR | 77 |
| 3H | RHEAAAPCQSRDPPG | 78 |
| 3I | AAPCQSRDPPGHAPP | 79 |
| 3J | QSRDPPGHAPPPLPG | 80 |
| 3K | PPGHAPPPLPGLPGG | 81 |
| 3L | APPPLPGLPGGAGKP | 82 |
| 3M | LPGLPGGAGKPGTHL | 83 |
| 3N | PGGAGKPGTHLPAHQ | 84 |
| 3O | GKPGTHLPAHQCQPV | 85 |
| 3P | THLPAHQCQPVLPAG | 86 |
| 3Q | AHQCQPVLPAGYPGG | 87 |
| 3R | QPVLPAGYPGGAGLR | 88 |
| 3S | PAGYPGGAGLRAHRS | 89 |
| 3T | PGGAGLRAHRSQPSE | 90 |
| 3U | GLRAHRSQPSEAGPT | 91 |
| 3V | HRSQPSEAGPTAEAA | 92 |
| 3W | PSEAGPTAEAADCAR | 93 |
| 3X | GPTAEAADCARHPAL | 94 |
| 3Y | EAADCARHPAL | 95 |

EXAMPLE 3

Mouse TERT Alternative Reading Frame Polypeptides

This example discloses alternative reading frame (ARF) polypeptides that were designed and synthesized based on the polynucleotide presented herein as SEQ ID NO: 6 (Genbank Accession No. NM_009354) that encodes the amino acid sequence of telomerase reverse transcriptase (mTERT) presented herein as SEQ ID NO: 5.

The mTERT polynucleotide sequence was analyzed for alternative reading frames encoding AUG initiated polypeptides of equal to or greater than 9 amino acids where the AUG is downstream of the AUG utilized for normal translation initiation. Fifteen ARF polypeptides were identified wherein an AUG sequence is within the rf1 or rf2 reading frame. In addition, the two polypeptides corresponding to reading frames rf1 and rf2 that initiate one and two nucleotides downstream, respectively, of the normal rf0 AUG initiation site were also included. In total, 12 of these ARF polypeptides are within the rf1 reading frame and 5 of these ARF polypeptides are within the rf2 reading frame. Overlapping peptides comprising these seventeen total mTERT alternative reading frame polypeptides are presented in Table 4.

ARF polypeptides corresponding to human TERT (hTERT) are disclosed in Table 5. Full-length hTERT polypeptide and polynucleotide sequences are disclosed herein as SEQ ID NOs: 3 and 4, respectively, and available through Genbank Accession No. NM_003219.

Pool 1 comprises 32 polypeptides, designated 3A through 5J, having an average length of 15 amino acids. These polypeptides correspond to two ARF open reading frames, a 100 amino acid rf2 polypeptide, initiating at nucleotide 3 and extending to nucleotide 302, and a 53 amino acid rf1 polypeptide, initiating at nucleotide 5 and extending to nucleotide 163.

Pool 2 comprises 23 polypeptides, designated 408A through 1214B, having an average length of 15 amino acids. These polypeptides correspond to four ARF open reading frames that are initiated by an AUG downstream of the site of normal translation initiation.

Pool 3 comprises 28 polypeptides, designated 1355A through 3240C, having an average length of 15 amino acids. These polypeptides correspond to nine ARF open reading frames that are initiated by an AUG downstream of, and distal to, the site of normal translation initiation.

TABLE 3

Mouse TERT Alternative Reading Frame Polypeptides (Derived from the polynucleotide presented herein as SEQ ID NO: 6, Genbank Accession No. NM_009354)

| Sequence | SEQ ID NO: |
|---|---|
| PALLVAPRCALCCAADTGRCGRWQP LCGAWGPRAGGLCNPGTRRSTALWL PNA | 96 |
| NDPRSSLPRGALSAAQPIPGGVAAGN LCAAPGARGQAACATRGPEDLPHFG CPMPSVHALGLTASTCRPFLPPGVIPE RAGGQGCAETLRAQREKRAGFWL | 97 |
| MPSVHALGLTASTCRPFLPPGVIPE RAGGQGCAETLRAQREKRAGFWL | 98 |
| MDATVEPSGRRPAGLPAGTLCSLS SGAPQLCLPGVWVSPVPNLCHHG YLALCVR | 99 |
| MLSCPESGGGTPQAGATNPIRQIM GAKSCSVPRGAYCRERFVF | 100 |
| MPFSSGHLLRPDISFTPGEMAKSV | 101 |
| MQSANMSDSSGHIAGFEQQTNR | 102 |
| MVFFGPVSARWCLLVSGVPGTM SAASLRT | 103 |
| MSGQNILTLWGLLYWV | 104 |
| MTSTGPGGPLCCVCVLWTRHPG CTLLRQM | 105 |
| MMPSPRVSWWRLLPI | 106 |
| MQWSGEIAKAKSTSPLGDRSPPS LTSSHTWASSLSICRIQMPVH | 107 |
| MRAAAACLTSSCTSCVTVS | 108 |
| MGCFYVLLMTFCW | 109 |
| MPRPQLRRASPSRVSSKLGRPCG TSSCRSCG | 110 |
| MSPGTSEDSPKTAVPEAPRGDND HP | 111 |

TABLE 4

Mouse TERT Alternative Reading Frame Polypeptide Pools (Designed based upon the mTERT ARF polypeptides presented in Table 3)

| Identifier | Sequence | SEQ ID NO: |
|---|---|---|
| Pool 1 | | |
| 3A | DPRSSLPRGALSAAQ | 112 |
| 3B | SLPRGALSAAQPIPG | 113 |
| 3C | GALSAAQPIPGGVAA | 114 |
| 3E | AAQPIPGGVAAGNLC | 115 |
| 3F | IPGGVAAGNLCAAPG | 116 |
| 3G | VAAGNLCAAPGARGQ | 117 |
| 3H | NLCAAPGARGQAACA | 118 |
| 3I | APGARGQAACATRGP | 119 |
| 3J | RGQAACATRGPEDLP | 120 |
| 3K | ACATRGPEDLPHFGC | 121 |
| 3L | RGPEDLPHFGCPMPS | 122 |
| 3M | DLPHFGCPMPSVHAL | 123 |
| 3O | FGCPMPSVHALGLTA | 124 |
| 3P | MPSVHALGLTASTCR | 125 |
| 3Q | HALGLTASTCRPFLP | 126 |
| 3R | LTASTCRPFLPPGVI | 127 |
| 3S | TCRPFLPPGVIPERA | 128 |
| 3T | FLPPGVIPERAGGQG | 129 |
| 3U | GVIPERAGGQGCAET | 130 |
| 3V | ERAGGQGCAETLRAQ | 131 |
| 3W | GQGCAETLRAQREKR | 132 |
| 3X | AETLRAQREKRAGFWL | 133 |
| 5A | PALLVAPRCALCCAA | 134 |
| 5B | VAPRCALCCAADTGR | 135 |
| 5C | CALCCAADTGRCGRW | 136 |
| 5D | CAADTGRCGRWQPLC | 137 |
| 5E | TGRCGRWQPLCGAWG | 138 |
| 5F | GRWQPLCGAWGPRAG | 138 |
| 5G | PLCGAWGPRAGGLCN | 140 |
| 5H | AWGPRAGGLCNPGTR | 141 |
| 5I | RAGGLCNPGTRRSTA | 142 |
| 5J | LCNPGTRRSTALWLPNA | 143 |
| Pool 2 | | |
| 408A | MDATVEPSGRRPAGL | 144 |
| 408B | VEPSGRRPAGLPAGT | 145 |
| 408C | GRRPAGLPAGTLCSL | 146 |
| 408D | AGLPAGTLCSLSSGA | 147 |
| 408E | AGTLCSLSSGAPQLC | 148 |
| 408F | CSLSSGAPQLCLPGV | 149 |
| 408G | SGAPQLCLPGVWVSP | 150 |
| 408H | QLCLPGVWVSPVPNL | 151 |
| 408I | PGVWVSPVPNLCHHG | 152 |
| 408J | VSPVPNLCHHGYLALCVR | 153 |
| 744A | MLSCPESGGGTPQAG | 154 |
| 744B | PESGGGTPQAGATNP | 155 |
| 744C | GGTPQAGATNPIRQI | 156 |
| 744D | QAGATNRIRQIMGAK | 157 |
| 744E | TNPIRQIMGAKSCSV | 158 |
| 744F | RQIMGAKSCSVPRGA | 159 |
| 744G | GAKSCSVPRGAYCRE | 160 |
| 744H | CSVPRGAYCRERFVF | 161 |
| 965A | MPFSSGHLLRPDISF | 162 |
| 965B | SGHLLRPDISFTPGE | 163 |
| 965C | LRPDISFTPGEMAKSV | 164 |
| 1214A | MQSANMSDSSGHIAG | 165 |
| 1214B | NMSDSSGHIAGFEQQTNR | 166 |
| Pool 3 | | |
| 1355A | MVFFGPVSARWCLLV | 167 |
| 1355B | GPVSARWCLLVSGVP | 168 |
| 1355C | ARWCLLVSGVPGTMS | 169 |
| 1355D | LLVSGVPGTMSAASLRT | 170 |
| 1970 | MSGQNILTLWGLLYWV | 171 |
| 2021A | MTSTGPGGPLCCVCV | 172 |
| 2021B | GPGGPLCCVCVLWTR | 173 |
| 2021C | PLCCVCVLWTRHPGC | 174 |
| 2021D | VCVLWTRHPGCTLLRQM | 175 |
| 2120 | MMPSPRVSWWRLLPI | 176 |
| 2204A | MQWSGEIAKAKSTSP | 177 |
| 2204B | GEIAKAKSTSPLGDR | 178 |

TABLE 4-continued

Mouse TERT Alternative Reading Frame Polypeptide Pools (Designed based upon the mTERT ARF polypeptides presented in Table 3)

| Identifier | Sequence | SEQ ID NO: |
|---|---|---|
| 2204C | KAKSTSPLGDRSPPS | 179 |
| 2204D | TSPLGDRSPPSLTSS | 180 |
| 2204E | GDRSPPSLTSSHTWA | 181 |
| 2204F | PPSLTSSHTWASSLS | 182 |
| 2204G | TSSHTWASSLSICRI | 183 |
| 2204H | TWASSLSICRIQMPVH | 184 |
| 2375A | MRAAAACLTSSCTSCVTVS | 185 |
| 2558 | MGCFYVLLMTFCW | 186 |
| 2825A | MPRPQLRRASPSRVS | 187 |
| 2825B | QLRRASPSRVSSKLG | 188 |
| 2825C | ASPSRVSSKLGRPCG | 189 |
| 2825D | RVSSKLGRPCGTSSC | 190 |
| 2825E | KLGRPCGTSSCRSCG | 191 |
| 3240A | MSPGTSEDSPKTAVP | 192 |
| 3240B | TSEDSPKTAVPEAPR | 193 |
| 3240C | SPKTAVPEAPRGDNDHP | 194 |

TABLE 5

Human TERT Alternative Reading Frame Polypeptides (Derived from the polynucleotide sequence presented herein as SEQ ID NO: 4, Genbank Accession No. NM_003219)

| Sequence | SEQ ID NO: |
|---|---|
| RCRALPAAEPCAPCCAATTARCCRW PRSCGAWGPRAGGWCSAGTRRLSAR WWPSAWCACPGTHGRPPPPPPSARC PA | 195 |
| DAARSPLPSRALPAAQPLPRGAAAG HVRAAPGAPGLAAGAARGPGGFPRA GGPVPGVRALGRTAAPRRPLLPPGV LPEGAGGPSAAEAVRARREERAGLR LRAAGRGPRGPPRGLHHQRAQLPAQ HGDRRTAGERGVGAAAAPRGRRRAG SPAGTLRALCAGGSQLRLPGVRAAA VPARRCHSGPAPATR | 196 |
| MSRRPRFKRTGSFSTGRVSGASCKA LESDST | 197 |
| MPWSRRPPMGTSARPSRATSL | 198 |
| MPSSSSRAPP | 199 |
| MRPAVASSTSSYASCATTPCA SGASPTSSARGSRRAPSSPRC SAACATATWRTSCLRGFGGTG CSCVWWMISCW | 200 |
| MPGPPSEPVSPSTAASRLGGT CVANSLGSCG | 201 |
| MCAAAPISSASLEEPHIFPAR HL | 202 |

EXAMPLE 4

Human TrpP8 Alternative Reading Frame Polypeptides

This example discloses alternative reading frame polypeptides that were designed and synthesized based on the polynucleotide presented herein as SEQ ID NO: 8 (Genbank Accession No. NM_024080) that encodes the amino acid sequence of human transient receptor potential cation channel 8 (hTrpP8) presented herein as SEQ ID NO: 7.

TABLE 6

Human TrpP8 Alternative Reading Frame Polypeptides (Derived from the polynucleotide presented herein as SEQ ID NO: 8, Genbank Accession No. NM_024080)

| Sequence | SEQ ID NO: |
| --- | --- |
| RCPFGQPGSA | 203 |
| DVLSGSQAQHEEQKE | 204 |
| MTLWTAPGPCTPARLGAQTCLTVKATW | 205 |
| MCLLYQRFQGHGECVQVWLCPEPAHGRHPDQPK | 206 |
| MCASVAMPRASTWKAPRSTKVRNGTTRNTPRNFLPTPLGIFSLRHWGRKGSIYVCPATRTRKSFTSC | 207 |
| MELQETHQGISYRRLWGYSV | 208 |
| MTSQEIHCISWTTTTHICCSWTMAVMDIPLSKQSSGIS | 209 |
| MVARSPLCVLPKEVEKR | 210 |
| MAQRNSRMFSPINSY | 211 |
| MPSPTLYTKPSAPVSKTRITGMGS | 212 |
| MMRFSPMTADGSLLTFKKSCLRLS | 213 |
| MMSSLNSSPTTSARLCTGICRSPRIPIM | 214 |
| MPSSRLSGNWLRTSEEASGRKTEMAGTRWT | |
| MLLGSPRSWLMSTRPGLLSCSLSVTAAMKTWQNSCWSIPVKLGVEATVWSWRWRPQTSISSPSLGSRIFFLSNGMERFPETPRTGRLSCVCLLYPWWAVALYHLGRNLSTSTRSCFGTMWRSSPPPSWSSPGMWSSTSPSSCCLPTCCSWISIRCHTPPSWSCTRWSLSSSVMK | 215 |
| MVWRDFPRHQELEDYPVSVYYTLGGLWLCII | 216 |
| MCSSSCSSLRCGWWPLAWPGKGSLGRMSSAGGGYSVRSSTSPTWPCSARCPVTWMVPRMTLPTAPSLGMSPSHCVWSWMSTTCPGSPSGSPSPWCASTCYPPTSCWSTCWSPCLATRWAPSRRTMTRSGSSRGTSWCRSTAAASISPSPSSSSLTSTWWMKTMRLWHGRVS | 217 |
| MGGCHEGKLPCQDQHKSQRHLRGNEASI | 218 |
|  | 219 |

TABLE 7

Human TrpP8 Alternative Reading Frame Polypeptide Pools (Designed based upon exemplary hTrpP8 ARF polypeptides, SEQ ID NOs: 203-208, presented in Table 6)

| Identifier | Sequence | NO: |
| --- | --- | --- |
| 2A | WRPFGQPGSA | 220 |
| 3A | GVLSGSRAQHEEQKE | 221 |
| 47A | MTLWTAPGPCTPARL | 222 |
| 47B | TAPGPCTPARLGAQT | 223 |
| 47C | PCTPARLGAQTCLTV | 224 |
| 47D | ARLGAQTCLTVKATW | 225 |
| 162A | MCLLYQRFQGHGECV | 226 |
| 162B | YQRFQGHGECVQVWL | 227 |
| 162C | QGHGECVQVWLCPEP | 228 |
| 162D | ECVQVWLCPEPAHGR | 229 |
| 162E | VWLCPEPAHGRHPDQ | 230 |
| 162F | PEPAHGRHPDQPK | 231 |
| 200A | MCASVAMPRASTWKA | 232 |
| 200B | VAMPRASTWKAPRST | 233 |
| 200C | RASTWKAPRSTKVRN | 234 |
| 200D | WKAPRSTKVRNGTTR | 235 |
| 200E | RSTKVRNGTTRNTPR | 236 |
| 200F | VRNGTTRNTPRNFLP | 237 |
| 200G | TTRNTPRNFLPTPLG | 238 |
| 200H | TPRNFLPTPLGIFSL | 239 |
| 200I | FLPTPLGIFSLRHWG | 240 |
| 200J | PLGIFSLRHWGRKGS | 241 |
| 200K | FSLRHWGRKGSIYVC | 242 |
| 200L | HWGRKGSIYVCPATR | 243 |
| 200M | KGSIYVCPATRTRKS | 244 |
| 200N | YVCPATRTRKSFTSC | 245 |
| 267A | MELQETHQGISYRRL | 246 |
| 267B | ETHQGISYRRLWGYSV | 247 |

EXAMPLE 5

Human PAP Alternative Reading Frame Polypeptides

This example discloses alternative reading frame polypeptides that were designed and synthesized based on the polynucleotide presented herein as SEQ ID NO: 10 (Genbank Accession No. M34840) that encodes the amino acid sequence of the human prostatic acid phosphatase (hPAP) variant presented herein as SEQ ID NO: 9 and the polynucleotide presented herein as SEQ ID NO: 12 (Genbank Accession No. X53605) that encodes the amino acid sequence of the hPAP variant presented herein as SEQ ID NO: 11.

TABLE 8

Human PAP Alternative Reading Frame Polypeptides (Derived from the polynucleotide presented herein as SEQ ID NO: 10, Genbank Accession No. M34840)

| Sequence | SEQ ID NO: |
| --- | --- |
| ELHPSSWPGQQALALASCFCFFSG | 248 |
| HESCTPPPGQGSKP | 249 |
| METEVPLTPFPLTP | 250 |
| MATRIWPTHPAGHGAAL | 251 |
| MSPINMNRFIFEAQTLTGL | 252 |
| MARTFLEFGVKSTTLYIVRVFTISLYPPGPLRTP | 253 |
| MEFTSRKRNLGSKGVSWSMKSSIT | 254 |
| MFTTDSFLPMLLAT | 255 |
| MRRSTSRIPSCYLAAALAVLWRGLLSWLAL | 256 |

TABLE 9

Human PAP Alternative Reading Frame Polypeptide Pool (Designed based upon the hPAP ARF polypeptides presented in Table 8)

| Identifier | Sequence | SEQ ID NO: |
| --- | --- | --- |
| 3A | ESCTPPPGQGSKP | 257 |
| 5A | ELHPSSWPGQQALAL | 258 |
| 5B | SSWPGQQALALASCF | 259 |
| 5C | GQQALALASCFCFFSG | 260 |
| 131A | METEVPLTPFPLTP | 261 |
| 186A | MATRIWPTHPAGHGAAL | 262 |
| 281A | MSPINMNRFIFEAQT | 263 |
| 281B | NMNRFIFEAQTLTGL | 264 |
| 593A | MARTFLEFGVKSTTL | 265 |
| 593B | FLEFGVKSTTLYIVR | 266 |
| 593C | GVKSTTLYIVRVFTI | 267 |
| 593D | TTLYIVRVFTISLYP | 268 |
| 593E | IVRVFTISLYPPGPL | 269 |

TABLE 9-continued

Human PAP Alternative Reading Frame Polypeptide Pool (Designed based upon the hPAP ARF polypeptides presented in Table 8)

| Identifier | Sequence | SEQ ID NO: |
|---|---|---|
| 593F | FTISLYPPGPLRTP | 270 |
| 740A | MEFTSRKRNLGSKGV | 271 |
| 740B | SRKRNLGSKGVSWSM | 272 |
| 740C | NLGSKGVSWSMKSSIT | 273 |
| 902A | MFTTDSFLPMLLAT | 274 |
| 998A | MRRSTSRIPSCYLAA | 275 |
| 998B | TSRIPSCYLAAALAV | 276 |
| 998C | PSCYLAAALAVLWRG | 277 |
| 998D | LAAALAVLWRGLLSW | 278 |
| 998E | LAVLWRGLLSWLAL | 279 |

TABLE 10

Human PAP Alternative Reading Frame Polypeptides (Derived from the polynucleotide presented herein as SEQ ID NO: 12, Genbank Accession No. X53605)

| Sequence | SEQ ID NO: |
|---|---|
| ELHPSSWPGQQA | 280 |
| HESCTPPPGQGSKLSLCFLFLLFLL ARPKCTSQGVEVCDFGVSAWTPKSH | 281 |
| MDTEVPLTPFPLTP | 282 |
| MATKDLANSPSWHGAAL | 283 |
| MSPINMNRFIFEAQTLTGL | 284 |
| MARTFLEFGVKSTTLYIVRVFTISL YPPGPLRTP | 285 |
| MEFTSRKRNLGSKGVSWSMKSSIT | 286 |
| MFTTDSFLPMLLAT | 287 |
| MRRSTSRIPSCYLDAAPAVLWRGL LSWLAL | 288 |
| MQPQLSSGEVC | 289 |

EXAMPLE 6

Human CA9 Alternative Reading Frame Polypeptides

This example discloses alternative reading frame polypeptides that were designed and synthesized based on the polynucleotide presented herein as SEQ ID NO: 295 (Genbank Accession No. NM_001216) that encodes the amino acid sequence of the human carbonic anhydrase IX (hCA9) presented herein as SEQ ID NO: 294.

TABLE 11

Human CA9 Alternative Reading Frame Polypeptides (Derived from the polynucleotide presented herein as SEQ ID NO: 295, Genbank Accession No. NM_001216)

| Sequence | SEQ ID NO: |
|---|---|
| WLPCAPAPGSLC | 296 |
| GSPVPQPLAPSVDPGPCSRPHCATA AVTAASDACPSPEVAPDAGGFPLGR RLFWGR | 297 |
| MTHWARRICPVKRIHPERRIHPERR IYLERRIYLERRIYLKLSLNQKKRAP | 298 |
| MPTGTKKGMTRVIGAMEATRPGPGC PQPARAASSPRWISAPSSPPSARPC APWNSWASSSRRSQNCACATMATVCN | 299 |
| MSSCCLAWKKSLRKAQRLRSQDWTY LHSCPLTSAATSNMRGL | 300 |

EXAMPLE 7

Human CEA Alternative Reading Frame Polypeptides

This example discloses alternative reading frame polypeptides that were designed and synthesized based on the polynucleotide presented herein as SEQ ID NO: 302 (Genbank Accession No. M17303) that encodes the amino acid sequence of the human carcinoembryonic antigen (hCEA) presented herein as SEQ ID NO: 301.

TABLE 12

Human CEA Alternative Reading Frame Polypeptides (Derived from the polynucleotide presented herein as SEQ ID NO: 302, Genbank Accession No. M17303)

| Sequence | SEQ ID NO: |
|---|---|
| LLHRGGQSRQQRPWSLPRPLPTDGA SPGRGSCSQPHF | 303 |
| FSTEEDRADSRDHGVSLGPSPQMVH PLAEAPAHSLTSNLLEPAHHCQAHY | 304 |
| MVHPLAEAPAHSLTSNLLEPAHHCQ AHY | 305 |
| MSQRGRRCFYLSTICPSIFLATAGT KVKIEWMATVKL | 306 |
| MTQDSTPYTS | 307 |
| MKKQLASSGYTRSCPSPPSPATTPN PWRTRMLWPSPVNLRLRTQPTCGG | 308 |
| MATGPSLYSMSQEMTQQATNVKPRTQ | 309 |
| MSSMARMPPPFPL | 310 |
| MQPLTHLHSTLGLSMGLSSNPPKSS LSPTSL | 311 |
| MQSHPNPSSPATTPTPWRMRML | 312 |
| MTTGPSLYSVSQGMM | 313 |
| MSSMAQTTPPFPPPHTPITVQG | 314 |
| MQPLTHLHSILG | 315 |
| MGTSSNTHKSSLSPTSLRRTADSIP ARPITQPVATAGLQSRQSQSLRSCP SPPSPATTPNPWRTRMLWPSPVNLR LRTQPTCGG | 316 |
| MVRASQSVPGCSCPMATGPSLYSMS QEMTQEPMYVESRTQ | 317 |
| MWNPELSECKPQ | 318 |
| MSSMGRTPPSFPPQTRLTFRERTST SPATRPLTHPRSILGVSMGYRSNTH KFSLSPKSRQIITGPMPVLSLTWLL AAIIP | 319 |

EXAMPLE 8

Human PSMA Alternative Reading Frame Polypeptides

This example discloses alternative reading frame polypeptides that were designed and synthesized based on the polynucleotide presented herein as SEQ ID NO: 345 (Genbank Accession No. NM_004467) that encodes the amino acid sequence of the human prostate-specific membrane antigen (hPSMA) presented herein as SEQ ID NO: 344.

TABLE 13

Human PSMA Alternative Reading Frame Polypeptides (Derived from the polynucleotide presented herein as SEQ ID NO: 345, Genbank Accession No. NM_004467)

| Sequence | SEQ ID NO: |
|---|---|
| CGISFTKPTRLWPPRAARAGCALGR WCWRVASFSSASSSGGL | 350 |

TABLE 13-continued

Human PSMA Alternative Reading Frame Polypeptides (Derived from the polynucleotide presented herein as SEQ ID NO: 345, Genbank Accession No. NM_004467)

| Sequence | SEQ ID NO: |
|---|---|
| VESPSRNRLGCGHRAPPALAVRWGA GAGGWLLSPRLPLRVVYKILQ | 351 |
| MKLLTLLQSII | 352 |
| MMSCCPTQIRLIPTTSQ | 353 |
| MKMEMRFSTHHYLNHLLQDMKMFRI LYHLSVLSLLKECQRAI | 354 |
| MLTMHELKTSLNWNGT | 355 |
| MGKFSEEIRLKMPSWQGPKESFSTP TLLTTLLLG | 356 |
| MVGIFLEVVSSVEIS | 357 |
| MVQETLSHQVTQQMNMLIGVELQRLL VFQVFLFIQLDTMMHRSS | 358 |
| MLDLALLETFLHKKSRCTSTLPMK | 359 |
| MSFWEVTGTHGCLVVLTLRVEQLLFM KL | 360 |
| MQKNLVFLVLLSGQRRIQDSFKSVAWL ILMLTHL | 361 |
| MKALKANLFMKVGLKKVLPQSSVACPG | 362 |
| MILRCSSNDLELLQAEHGILKIGKQTNSA AIHCITVSMKHMSWWKSFMIQCLNITSL WPRFEEGWCLS | 363 |
| MLTKSTVFL | 364 |
| MINSCFWKEHLLIH | 365 |
| MSSMLQAATTSMQGSHSQEFMMLCL ILKAKWTLPRPGEK | 366 |
| MLQPSQCRQLQRL | 367 |

EXAMPLE 9

Human PSA Alternative Reading Frame Polypeptides

This example discloses alternative reading frame polypeptides that were designed and synthesized based on the polynucleotide presented herein as SEQ ID NO: 369 (Genbank Accession No. M26663) that encodes the amino acid sequence of the human prostate-specific antigen (hPSA) presented herein as SEQ ID NO: 368.

TABLE 14

Human PSA Alternative Reading Frame Polypeptides (Derived from the polynucleotide presented herein as SEQ ID NO: 369, Genbank Accession No. M26663)

| Sequence | SEQ ID NO: |
|---|---|
| CGSRLSSSPCP | 374 |
| VGPGCLPHPVRDVDWCCTPHPVSDC GRLGVREAFPTLAGACGLSWQGSLR RCSGAPPVGPHSCPLHQEQKRDLAG SAQPVSS | 375 |
| MTPATTSCCSACQSLPSSRML | 376 |
| MLFPMTCVRKFTLRR | 377 |
| MVCFKVSRHGAVNHVPCPKGLPCTPR WCITGSGSRTPSWPTP | 378 |
| MCPARKAFPVHQGGALPEVDQGHHR GQP | 379 |

EXAMPLE 10

Human P53 Alternative Reading Frame Polypeptides

This example discloses alternative reading frame polypeptides that were designed and synthesized based on the polynucleotide presented herein as SEQ ID NO: 381 (Genbank Accession No. M14695) that encodes the amino acid sequence of the human p53 cellular tumor antigen (hp53) presented herein as SEQ ID NO: 380.

TABLE 15

Human p53 Alternative Reading Frame Polypeptides (Derived from the polynucleotide presented herein as SEQ ID NO: 381, Genbank Accession No. M14695)

| Sequence | SEQ ID NO: |
|---|---|
| WRSRSQILASSPL | 386 |
| MKLPECQRLLPPWPLHQRLLHRRPL HQPPPGPCHLLSLPRKPTRAATVSV WASCILGQPSL | 387 |
| MSAAQIAMVWPLLSILSEWKEICVW SIWMTETLFDIVWWCPMSRLRLALT VPPSTTTTCVTVPAWAA | 388 |
| MENISPFRSVGVSASRCSES | 389 |
| MRPWNSRMPRLGRSQGGAGLTPAT | 390 |

EXAMPLE 11

Human PGY1 Alternative Reading Frame Polypeptides

This example discloses alternative reading frame polypeptides that were designed and synthesized based on the polynucleotide presented herein as SEQ ID NO: 392 (Genbank Accession No. M14758) that encodes the amino acid sequence of the human P-glycoprotein or multi drug resistant protein 1 (hPGY1 or hMDR1) presented herein as SEQ ID NO: 391.

TABLE 16

Human PGY1 Alternative Reading Frame Polypeptides (Derived from the polynucleotide presented herein as SEQ ID NO: 392, Genbank Accession No. M14758)

| Sequence | SEQ ID NO: |
|---|---|
| WILKGTAMEEQRRRTFLN | 397 |
| MPIITVELVLGCWLLLTFRFHFGAW QLEDKYTKLENSFFML | 398 |
| MCTMLGSLTPDLQMMSLRLMKLLVT KLECSFSQWQHFSLGL | 399 |
| MHLMLWPSGMGPPWSSQGNILLDKY SLYSFLY | 400 |
| MQEEQLMKSSR | 401 |
| MFTSVTHLEKKLRS | 402 |
| MTPQRGWSVLMDRILGP | 403 |
| MAVKMSPWMRLRKLSRKPMPMTLS | 404 |
| MRPRQPWTQKAKQWFRWLWIRPEKV GPPL | 405 |
| MLTSSLVSMMESLWRKEIMMNS | 406 |
| MQLMNPKVKLMPWKCLQMIQDPV | 407 |
| MKVYLQFPFGGL | 408 |
| MALFCCWCILCHYKWRPATSICNNI FKDYRGFYKN | 409 |
| MEACNQHLQ | 410 |
| MILKQNDRIVTCFHYCF | 411 |
| MTLKTPLEH | 412 |
| MMLLKLKGL | 413 |
| MLRVCRYHTETL | 414 |
| MLDVSGLEPTWWHINS | 415 |

TABLE 16-continued

Human PGY1 Alternative Reading Frame Polypeptides (Derived from the polynucleotide presented herein as SEQ ID NO: 392, Genbank Accession No. M14758)

| Sequence | SEQ ID NO: |
|---|---|
| MFPVWSLLGGT | 416 |
| MPKPKYQQPTSS | 417 |
| MSHLVKLYSTIPPDRTSQCFRD | 418 |
| MFSGSEHTWASCPRSPSCLTAALLR TLPMETTAGWCHRKRS | 419 |
| MPSSSHCLINIALK | 420 |
| MKPRQLWIQKVKRLSKKPWTKPEKAA PAL | 421 |
| MAESRSMARISSCWHRKASIFQWSVS RLEQSAS | 422 |

EXAMPLE 12

Human AFP Alternative Reading Frame Polypeptides

This example discloses alternative reading frame polypeptides that were designed and synthesized based on the polynucleotide presented herein as SEQ ID NO: 424 (Genbank Accession No. NM_001134) that encodes the amino acid sequence of the human alpha-fetoprotein (hAFP) presented herein as SEQ ID NO: 423.

TABLE 17

Human AFP Alternative Reading Frame Polypeptides (Derived from the polynucleotide presented herein as SEQ ID NO: 424, Genbank Accession No. NM_001134)

| Sequence | SEQ ID NO: |
|---|---|
| EVGGINFFNFPTKFY | 429 |
| MRKKFWRSTDIQTAAAKVKREDITV FLHTKSPLQHRSHFSKFQNLSQAVKH MKKTGRHS | 430 |
| MHLQFFFGLLAMTK | 431 |
| MQLNASKQRQQQLQKN | 432 |
| MLPNKGSNSYKRIKRKQLVKSTCMC SNEKFWDPNFPSHNCY | 433 |
| MWPMYMSTVAEEMCWIVCRMGKKSC PTYVLNKTLCQTK | 434 |
| MFSTRHSVKQNNRMLQTDHAGTWSM YNSCRK | 435 |
| MQKMMKNLKVYLQI | 436 |
| MNIQEDILSLLSQ | 437 |
| MRFSLLTQRKPPS | 438 |
| MPTGGHASAAWWWMKHMSLLHSLMT SSFSIRICAKLRV | 439 |

EXAMPLE 13

Human MUC1 Alternative Reading Frame Polypeptides

This example discloses alternative reading frame polypeptides that were designed and synthesized based on the polynucleotide presented herein as SEQ ID NO: 441 (Genbank Accession No. AF125525) that encodes the amino acid sequence of the human mucin precursor (hMUC1) presented herein as SEQ ID NO: 440.

TABLE 18

Human MUC1 Alternative Reading Frame Polypeptides (Derived from the polynucleotide presented herein as SEQ ID NO: 441, Genbank Accession No. AF125525)

| Sequence | SEQ ID NO: |
|---|---|
| DTGHPVSFLPAAAPHSAYRFWSCKL YPRWRKGDFGYPEKFSAQLY | 446 |
| HRAPSLLSSCCCSSQCLQVLVMQAL PQVEKRRLRLPREVQCPALLRRMLL IPLWKIPAPTTTKSCRETFLKCFCRF INKGVFWASPILSSGQDLWWYN | 447 |
| MSTTWRHSSISIKRKQPLDIT | 448 |
| MCHFLSLPSLGLGCQAGASRCWCWS VFWLRWPLSISLPWLSVSAAERTTGS WTSFQPGIPTIL | 449 |
| MGAMCPLAVPIVAPMRRFLQVMVAA ASLTQTQQWQPLLPTC | 450 |

EXAMPLE 14

Human Frame Alternative Reading Frame Polypeptides

This example discloses alternative reading frame polypeptides that were designed and synthesized based on the polynucleotide presented herein as SEQ ID NO: 452 (Genbank Accession No. U65011) that encodes the amino acid sequence of the human preferentially expressed antigen of melanoma (hPRAME) presented herein as SEQ ID NO: 451.

TABLE 19

Human PRAME Alternative Reading Frame Polypeptides (Derived from the polynucleotide presented herein as SEQ ID NO: 439, Genbank Accession No. U65011)

| Sequence | SEQ ID NO: |
|---|---|
| WNEGVCGVPFRADTSA | 457 |
| GTKAFVGFHSEPIHQHECVDKPTETC GAGRAEPAEG | 458 |
| MRPWPLPPWSCCPGSSSRHSSWQPL TGDTARP | 459 |
| MDLMCSLPRRFAPGGGNFKCWIYGRT LIRTSGLYGLETGPVCTH-FQSQKQLSP | 460 |
| MVWKQGQSVLISRARSSSAHDKEAK SRWFEHRGRAALHSSRGARRLPVPQG RCL | 461 |
| MNCSPTSLRK | 462 |
| MYYACAVRS | 463 |
| MHLPTFPRRRKSSISPSSPLSSSVC SACRLSMWTLYFSLEAAWISCSGT | 464 |
| MSVGSRMISSLPSCLP | 465 |
| MRTSMVPSTWRGLPICMPGSGSCCV SWGGPAWSGLVPTPVLTVGTEPSMTR SPSCAPVSCLT | 466 |

EXAMPLE 15

Human EPHA3 Alternative Reading Frame Polypeptides

This example discloses alternative reading frame polypeptides that were designed and synthesized based on the polynucleotide presented herein as SEQ ID NO: 468 (Genbank Accession No. AF213459) that encodes the amino acid sequence of the human ephrin receptor (hEPHA3) presented herein as SEQ ID NO: 467.

TABLE 20

Human EPHA3 Alternative Reading Frame Polypeptides (Derived from the polynucleotide presented herein as SEQ ID NO: 455, Genbank Accession No. AF213459)

| Sequence | SEQ ID NO: |
|---|---|
| WIVSSPSSSFSAALFSTASGN | 473 |
| GLSALHPPPSQLLCSRQLRGTDSAAFQ | 474 |
| MWSSSSLYETAIAFHWF | 475 |
| MKVSLKWILGTVF | 476 |
| MLVLVLPWCL | 477 |
| MACTHWQVFLQCWL | 478 |
| MLAMKKEVLCAKLVDQVSTRHWMVI | 479 |
| MLPSTSYVKNVGGI | 480 |
| MQPKCPLPPSTVWTHQHHGDSDRPSGTY | 481 |
| MSASSLDSLDSPTPR | 482 |
| MGSYWTTRSNTMKSRNKKQVIPF | 483 |
| MLPSVASSLTLYTYSKSEPEQPLDM GRTAASLSLKLVQTLSPSLVKVAKWS | 484 |
| MGQMKKDFILAMGI | 485 |
| MLTHIHMKTLPKLFMSLPRNWMPPT YPLIKLLEQVNLERCAVVA | 486 |
| MVPWIVSYVNTMPSLLSFS | 487 |
| MFTETSLLGTS | 488 |
| MTQKLLIQQEEGRSQSGGHHQKL | 489 |
| MYGVMGLFSGR | 490 |
| MELWDCSLGGDVLWRETILGDVQSGCN | 491 |
| MERDHTGRCPIRM | 492 |
| MRAIDCHPPWTAQLPCIS | 493 |
| MWISLPSAQQVTGLMVSGQHTARKSS RVWSTVLVTQ | 494 |

EXAMPLE 16

Human PIN1 Alternative Reading Frame Polypeptides

This example discloses alternative reading frame polypeptides that were designed and synthesized based on the polynucleotide presented herein as SEQ ID NO: 496 (Genbank Accession No. U49070) that encodes the amino acid sequence of the human peptidyl-prolyl isomerase and essential mitotic regulator (hPIN1) presented herein as SEQ ID NO: 495.

TABLE 21

Human PIN1 Alternative Reading Frame Polypeptides (Derived from the polynucleotide presented herein as SEQ ID NO: 496, Genbank Accession No. U49070)

| Sequence | SEQ ID NO: |
|---|---|
| MWRTRRSCRPAGRSA | 501 |
| MGGRGEAAARLGEAHEPQLRPSVLL QPHH | 502 |

EXAMPLE 17

Human Base Alternative Reading Frame Polypeptides

This example discloses alternative reading frame polypeptides that were designed and synthesized based on the polynucleotide presented herein as SEQ ID NO: 504 (Genbank Accession No. AY180924) that encodes the amino acid sequence of the human BASE (hBASE) presented herein as SEQ ID NO: 503.

TABLE 22

Human BASE Alternative Reading Frame Polypeptides (Derived from the polynucleotide presented herein as SEQ ID NO: 504, Genbank Accession No. AY180924)

| Sequence | SEQ ID NO: |
|---|---|
| AECLRPLCSPLWAACLILCTGGPGWS FFPAP | 509 |
| MSPASLFSSVGCLSHPLHRRSWLEFL PSSLMI | 510 |
| MVYQASWTSLDLHSPMRSTLLAYR | 511 |
| MSPSRAPLKERRPLYKYHSRLS | 512 |
| MSLPLGTAGSCPRLFGSKLESNSPQR KICCGKH | 513 |

EXAMPLE 18

Human PSCA Alternative Reading Frame Polypeptides

This example discloses alternative reading frame polypeptides that were designed and synthesized based on the polynucleotide presented herein as SEQ ID NO: 515 (Genbank Accession No. AF043498) that encodes the amino acid sequence of the human prostate stem cell antigen (hPSCA) presented herein as SEQ ID NO: 514.

TABLE 23

Human PSCA Alternative Reading Frame Polypeptides (Derived from the polynucleotide presented herein as SEQ ID NO: 515, Genbank Accession No. AF043498)

| Sequence | SEQ ID NO: |
|---|---|
| EGCAACPVDGRLGPAARHCPAVLLL QSPGEQRGLPAGGELHPAGGAVLDR AHPRSWPPDRHQQRLQLELRG | 520 |
| MTHRTTTWARRTSRAVTPTCATPAG PMPCSRLPPSLRCSLHSACCSGDPAS | 521 |

EXAMPLE 19

Human SURVIVIN Alternative Reading Frame Polypeptides

This example discloses alternative reading frame polypeptides that were designed based on the polynucleotide presented herein as SEQ ID NO: 549 (Genbank Accession No. AF077350) that encodes the amino acid sequence of the human SURVIVIN (hSURVIVIN) presented herein as SEQ ID NO: 550. The "full-length" rf1 protein sequence is presented herein as SEQ ID NO: 553, which is encoded by the polynucleotide sequence presented herein as SEQ ID NO: 554. The "full-length" rf2 protein sequence is presented herein as SEQ ID NO: 555, which is encoded by the polynucleotide sequence presented herein as SEQ ID NO: 556.

TABLE 24

Human SURVIVIN Alternative Reading Frame Polypeptides (Derived from the polynucleotide presented herein as SEQ ID NO: 549, Genbank Accession No. AF077350)

| Sequence | SEQ ID NO: |
|---|---|
| WVPRRCPLPGSPFSRTTASLHSRTG PSWRAAPAPRSGWPRLASSTAPLRT SQTWPSVSSASRSWKAGSQMTTP | 551 |
| GCPDVAPCLAALSQGPPHLYIQELA LLGGLRLHPGADGRGWLHPLPH | 552 |
| MWVPRRCPLPGSPFSRTTASLHSRT GPSWRAAPAPRSGWPRLASSTAPLR TSQTWPSVSSASRSWKAGSQMTTPR NIKSIRPVALSFLSRSSLKNNWTEK EPRTKLQRKPTIRRKNLRKLRRKCA VPSSSWLPWI | 553 |
| MGCPDVAPCLAALSQGPPHLYIQEL ALLGGLRLHPGADGRGWLHPLPHER ARLGPVFLLLQGAGRLGARKAFVRL RFPFCQEAVIFETGQRKSQEQNCKG NQQGNCEESAPCHRAAGCHGL | 555 |

EXAMPLE 20

Human WTI Alternative Reading Frame Polypeptides

This example discloses alternative reading frame polypeptides that were designed based on the polynucleotide presented herein as SEQ ID NO: 557 (Genbank Accession No. NM_000378) that encodes the amino acid sequence of the human WTI (hWTI) presented herein as SEQ ID NO: 558. The "full-length" rf1 protein sequence is presented herein as SEQ ID NO: 562, which is encoded by the polynucleotide sequence presented herein as SEQ ID NO: 563. The "full-length" rf2 protein sequence is presented herein as SEQ ID NO: 564, which is encoded by the polynucleotide sequence presented herein as SEQ ID NO: 565.

TABLE 25

Human WTI Alternative Reading Frame Polypeptides (Derived from the polynucleotide presented herein as SEQ ID NO: 557, Genbank Accession No. NM_000378)

| Sequence | SEQ ID NO: |
|---|---|
| GLRRAGPERAAARRPLPGWRRRLCP ACERRGAVGAGAGLCAPGRFGLRVV GRPRAATGSAATPAAAASLLHQTGA ELGRRGAARGAVPERLHCPLFRPVH WHSRSLSLRALRSSSAQPGVIRPGQ DVS | 559 |
| MRRSSPTTHSSMRIPWASRARWVSS STRCRPRSMAATPPPTAAPAARLCC MHDLESDELRSHLKGPQHRVRER | 560 |
| | 561 |
| MWAPTCGTTRCCPPSPPWVAAAAVP CLAARRSGRRCWTLRPRALRLTGRW AAPRRHRLRRHPRRRRLTPSSNRSR AGAARSRTRSSAAPSLSTFPASSLA QPEPVATGPSVLLRPARRHPARPGC FLTRPTCPAASRASPLFAIRVTARS PSTGRPATVTRPRTMRRSSPTTHSS MRIPWASRARWVSSSTRCRPRSMAA TPPPTAAPAARLCCGRPTAVTIYTK RATAQGTRAITTQRPSSAEPNTEYT RTVSSEAFRMCDVCLEPRLLYGRHL RPVRNAPSCVLTQAAIRDILSCPTY RCTAGSTLVRNHTSVTSRTVNEGFL | 562 |

TABLE 25-continued

Human WTI Alternative Reading Frame Polypeptides (Derived from the polynucleotide presented herein as SEQ ID NO: 557, Genbank Accession No. NM_000378)

| Sequence | SEQ ID NO: |
|---|---|
| VQTSSKDTKGDIQVNHSSVKLVSES SPGPTTRPTPGLIQVKSPSAVGGQV VRKSLPGQMNSAITTCIRET | |
| MGLRRAGPERAAARRPLPGWRRRLC PACERRGAVGAGAGLCAPGRFGLRV VGRPRAATGSAATPAAAASLLHQTG AELGRRGAARGAVPERLHCPLFRPV HWHSRSLSLRALRSSSAQPGVIRPG QDVSRALPAQLPREPARYSQSGLQH GHLRRDAQLRSHALAPCGAVPQPLI QAGSHGPAGLAGAAVLGAAPGLWLP HPHRQLHRQPGFAAEDALQQQFIPN DIPAMHDLESDELRSHLKGPQHRVR ERPHNAHPLRSPIQNTHARCLQRHS GCATCAWSSPDSCTVGIETPLHVCL PRLQAVPLTDAQQEAHWTKVFSFRP AQKTPKETYRCETIPVSLSAKVLPV RPPEDPHQDSYRKALQLSVAKLSEK VCPVRISPPSQHASEKHDQTPAGA | 564 |

EXAMPLE 21

Human SGA-M1 Alternative Reading Frame Polypeptides

This example discloses alternative reading frame polypeptides that were designed based on the polynucleotide presented herein as SEQ ID NO: 566 (Genbank Accession No. AY192728) that encodes the amino acid sequence of the human SGA-M1 (hSGA-M1) presented herein as SEQ ID NO: 567. The "full-length" rf1 protein sequence is presented herein as SEQ ID NO: 575, which is encoded by the polynucleotide sequence presented herein as SEQ ID NO: 576. The "full-length" rf2 protein sequence is presented herein as SEQ ID NO: 577, which is encoded by the polynucleotide sequence presented herein as SEQ ID NO: 578.

TABLE 26

Human SGA-M1 Alternative Reading Frame Polypeptides (Derived from the polynucleotide presented herein as SEQ ID NO: 566, Genbank Accession No. AY192728)

| Sequence | SEQ ID NO: |
|---|---|
| WRWRWRRWRRSSRPAAAGTSSCRMK KSLEN | 568 |
| GVGVGGAGGGRAGLRQPVPAVAE | 569 |
| MKKSLENLNRLQVMLLHLTAAFLQR AQHILTTRMSLGFQSPHLTM | 570 |
| MMKRRGPRLKLLSLWFLGEMRILWV GMILMMLTS | 571 |
| MGPFQDLVSL | 572 |
| MDPDCQVFHLFPWIF | 573 |
| MVSTGSGGCSLF | 574 |
| MWRWRWRRWRRSSRPAAAGTSSCRM KKSLENLNRLQVMLLHLTAAFLQRA QHILTTRMSLGFQSPHLTMLQHCPV MMKRRGPRLKLLSLWFLGEMRILWV GMILMMLTSLFSWHSSLTGLGFSCL FAPLQLQEGMGPFQDLVSLLSGFPP ISLDILMVSTGSGGCSLFAFSCFSE DLSIMQKFGRCQKLSQISPGPEFSL F | 575 |
| MGVGVGGAGGGRAGLRQPVPAVAEC | 577 |

TABLE 26-continued

Human SGA-M1 Alternative Reading Frame Polypeptides (Derived from the polynucleotide presented herein as SEQ ID NO: 566, Genbank Accession No. AY192728)

| Sequence | SEQ ID NO: |
|---|---|
| SSTLQQHFCRERSIFVWVSKAPILQ | |
| CSYNTAQLSYYPFGSWERWDFHVNF | |
| FHGIPLLDWVFPVFLPDHFSCRKVW | |
| GHFRIWSLSNMDPDCQVFHLFPWIF | |
| WSVLALVGVPCFRLSPVSQRIYQLC | |
| KSSEDARNFLKSPQDQSSLYL | |

EXAMPLE 22

Human RCAS1 Alternative Reading Frame Polypeptides

This example discloses alternative reading frame polypeptides that were designed based on the polynucleotide presented herein as SEQ ID NO: 579 (Genbank Accession No. AF006265) that encodes the amino acid sequence of the human RCAS1 (hRCAS1) presented herein as SEQ ID NO: 580. The "full-length" rf1 protein sequence is presented herein as SEQ ID NO: 588, which is encoded by the polynucleotide sequence presented herein as SEQ ID NO: 589. The "full-length" rf2 protein sequence is presented as SEQ ID NO: 590, which is encoded by the polynucleotide sequence presented herein as SEQ ID NO: 591.

TABLE 27

Human RCAS1 Alternative Reading Frame Polypeptides (Derived from the polynucleotide presented herein as SEQ ID NO: 579, Genbank Accession No. AF006265)

| Sequence | SEQ ID NO: |
|---|---|
| WPSPSFGYLNFVPA | 581 |
| MQIWQRTEIKWRPNNFANYS | 582 |
| MLKSGLPGMKMHPPV | 583 |
| MGMWQHNKILWNNWNLTILRT | 584 |
| MGAQVSLVD | 585 |
| MHGKKKKMQPGKQKKF | 586 |
| MGRRRRCSLASRRSSETAETSRQRK ESSRTTKEENGKGSTTANEEGTKQN WCETFI | 587 |
| MWPSPSFGYLNFVPAYADLAEDGNL CQLQLIIHQFLSRQMLKSGLPGMKM HPPVRSKEGMGMWQHNKILWNNWNL TILRTHQLLGKLRKLLLRRENHILA SQMGAQVSLVDQLHKICLLFISLLN IPGRKIPMHGKKKKMQPGKQKKFQT EKREQPNNKGRKWKRKHNG | 588 |
| MGHHPVSVIILYLPSNSILIPKEIN MQIWQRTEIKWRPMNNFANYSRCTH QCKDRRREWECGNTTKFFGTTGTEE RTIEFWHPRWEHRFLISSYTRSAFY SSVFLRYLAGKYQCMGRRRRCSLAS RRSSETAETSRQRKESSRTTKEENG KGSTTANEEGTKQNWCETFI | 590 |

EXAMPLE 23

Human CYP1B1 Alternative Reading Frame polypeptides

This example discloses alternative reading frame polypeptides that were designed based on the polynucleotide presented herein as SEQ ID NO: 592 (Genbank Accession No. NM_000104) that encodes the amino acid sequence of the human CYP1B1 (hCYP1B1) presented herein as SEQ ID NO: 593. The "full-length" rf1 protein sequence is presented herein as SEQ ID NO: 599, which is encoded by the polynucleotide sequence presented herein as SEQ ID NO: 600. The "full-length" rf2 protein sequence is presented herein as SEQ ID NO: 601, which is encoded by the polynucleotide sequence presented herein as SEQ ID NO: 602.

TABLE 28

Human CYP1B1 Alternative Reading Frame Polypeptides (Derived from the polynucleotide presented herein as SEQ ID NO: 592, Genbank Accession No. NM_000104)

| Sequence | SEQ ID NO: |
|---|---|
| WAPASARTTLGR | 594 |
| MASAPSTRPWCSRARPSPTGRPSPP | 595 |
| SVWCPAAAAWLSATTRSTGRCSGAQ PTA | |
| MCRLECRQNWIRSWGGTVCLVWVTS PTCPMSWPSFMKPCASPALCLSLFL MPPLPTPLSWATTFPRTLWFLSTSG L | 596 |
| MSLSESPWSSLIVLSKIYKPRKLAN | 597 |
| GHQPQPERPLAAKPAVHPADHAPAT PVGAGHCACGPAAAEATEAAAPVRA PGPVCVATDRKRGGGGPGGSPLVRS PGAALRRRFPDPPGQLPHSGAEWRA RHPPGPGAAGLGLRRPAGLRLLPCG VRRPQHGFRPLLGALEGAAARSPQH DAQLLHAPAAQPPSPRGPRAERGAR AGGAAGARQRGRRLPRPEAADRRGR GQRHECRVFRLPLQPRRPRVP | 598 |
| MWAPASARTTLGRTRCPSSRPRSCY SCRCWPLCMWASGCGNGGGSSGPRP RARLRGHSETRRRWARRLTSRSLAW RGATATFSRSAWAAAPMASAPSTRP WCSRARPSPTGRPSPPSVWCPAAAA WLSATTRSTGRCSGAQPTACATSSR ASRAAAKSSRATCARRASWWRCWCA AARTAPSSTRGRVPCVSAAATATTT PSSVSCSATTKSSGARWARAAWWTC PGCSTSPTRCAPFSANSSSSTATSA TSSWTSSGTAKAFGPGPPPATWTPL SSLRKRRRPGTRTVVARGWIWRTYR PLSLTSSAPARTPCPPRCSGCSSSS PGILMCRLECRQNWIRSWGGTVCLV WVTSPTCPMSWPSFMKPCASPALCL SLFLMPPLPTPLSWATTFPRTLWFL STSGLSGLTRRTLIQLDSWTRMASS TRTFFQWAKGGALAKNFLRCSFFSS SPSWLTSAISGPTQMSLRKPLNPSH LKSMSLSESPWSSLIVLSKIYKPRK LAN | 599 |
| MGHQPQPERPLAAKPAVHPADHAPA TPVGAGHCACGPAAAEATEAAAPVR APGPVCVATDRKRGGGGPGGSPLVR SPGAALRRRFPDPPGQLPHSGAEWR ARHPPGPGAAGLGLRRPAGLRLLPC GVRRPQHGFRPLLGALEGAAARSPQ HDAQLLHAPAAQPPSPRGPRAERGA RAGGAAGARQRGRRLPRPEAADRRG RGQRHECRVFRLPLQPRRLPRVPAAQ PQRRVRAHGGRGQPGGRDALAAVLP QPGAHRFPRIRAAQPQLQQLHPGQV LEALRKPSARGRPPRHDGRLYPLCG KEGGRGLARWWRAAGFGERTGHYHH LRRQPGHPVHRAAVAAPPLHQVSCA DSSAGRIGSGRGEGPSALYGPAQPA LCPGLPLSHALLQLCACHYSSCHHC QHLCLGLPHSQGHCGFCQPVVCESS SSILGQGWPHQQGPDQQSDDFFSGQ KAVHWRRTFDAAFSLHLHPGSPVRF QGQPKACENEFQLWSNHSQCHSQRV HGAPCCPKFTSQGNLPI | 601 |

EXAMPLE 24

Putative Alternative Reading Frame Peptides Based Upon the 5' Untranslated Regions (UTRs) OF Various Human Tumor Associated Antigens (TAA)

This example discloses alternative reading frame polypeptides that were designed based on the polynucleotides of various human Tumor Associated Antigens presented herein. The 5' UTR alternative reading frame peptides presented in Table 29 were designed in accordance with the following rules:

(1) Sequences downstream of the mRNA 5' cap that encode open reading frames encoding 9 or more residues in all three (rf0, rf1, and rf2) registers. rf0 peptides are presented as "alternative" reading frame peptides because they do not comprise an element of the native full-length protein. The sequence downstream from the 5' CAP is a convenient 5' boundary for identifying ARF sequences of the present invention.

(2) A 5' AUG initiation codon is not required for expression of 5' ARF sequences. Ribosomes can be primed to initiate translation via alternative "AUG-like" codons that serve to initiate translation.

(3) The distance between the Cap 5' UTR potential ARFs and the structural gene initiation AUG codon will vary from gene to gene.

(4) As a point of reference, number one is the A nucleotide of the canonical AUG and negative one is the nucleotide directly preceding the A of the canonical AUG.

TABLE 29

Alternative Reading Frame Polypeptides Designed Based upon the 5' Untranslated Regions of Human Tumor Associated Antigens Disclosed Herein

| Sequence | SEQ ID NO: | Description |
| --- | --- | --- |
| TCCATATTGTGCTTCCACCACTGCC AATAACAAAATAACTAGCAACC | SEQ ID NO: 603 | Nucleotide sequence of hAFP (Genbank Accession No. NM_001134) 5' UTR |
| HIVLPPLPITKLATM | SEQ ID NO: 604 | Amino acid sequence of hAFP 5' UTR alternative reading frame rf0 peptides |
| HIVLPPLPITK | SEQ ID NO: 605 | Amino acid sequence of hAFP 5' UTR alternative reading frame rf0 peptide A |
| SILCFHHCQQNNQP | SEQ ID NO: 606 | Amino acid sequence of hAFP 5' UTR alternative reading frame rf1 peptides |
| SILCFHHCQ | SEQ ID NO: 607 | Amino acid sequence of hAFP 5' UTR alternative reading frame rf1 peptide A |
| PYCASTTANNKITSNH | SEQ ID NO: 608 | Amino acid sequence of hAFP 5' UTR alternative reading frame rf2 peptide |
| GGCCAGAGTGTCTTGACAGCACACC AGAGAAATCCAGGGACCTGACCGAA G | SEQ ID NO: 609 | Nucleotide sequence of hBASE (Genbank Accession No. AY180924) 5' UTR |
| GQSVLTAHQRNPGTPKM | SEQ ID NO: 610 | Amino acid sequence of hBASE 5' UTR alternative reading frame rf0 peptides |
| GQSVLTAHQRNPGT | SEQ ID NO: 611 | Amino acid sequence of hBASE 5' UTR alternative reading frame rf0 peptide A |
| ARVSQHTREIQGPDRR | SEQ ID NO: 612 | Amino acid sequence of hBASE 5' UTR alternative reading frame rf1 peptides |
| QHTREIQGPDRR | SEQ ID NO: 613 | Amino acid sequence of hBASE 5' UTR alternative reading frame rf1 peptide A |
| PECLDSTPEKSRDLTED | SEQ ID NO: 614 | Amino acid sequence of hBASE 5' UTR alternative reading frame rf2 peptides |
| GCCCGTACACACCGTGTGCTGGGAC ACCCCACAGTCAGCCGC | SEQ ID NO: 615 | Nucleotide sequence of hCA9 (Genbank Accession No. NM_001216) 5' UTR |

TABLE 29-continued

Alternative Reading Frame Polypeptides Designed
Based upon the 5' Untranslated Regions
of Human Tumor Associated Antigens Disclosed Herein

| Sequence | SEQ ID NO: | Description |
|---|---|---|
| ARTHRVLGHPTVSR | SEQ ID NO: 616 | Amino acid sequence of hCA9 5' UTR alternative reading frame rf0 peptides |
| PVHTVCWDTPQSAA | SEQ ID NO: 617 | Amino acid sequence of hCA9 5' UTR alternative reading frame rf1 peptides |
| PYTPCAGTPHSQPH | SEQ ID NO: 618 | Amino acid sequence of hCA9 5' UTR alternative reading frame rf2 peptides |
| CGACCAGCAGACCAGACAGTCACAG CAGCCTTGACAAAACGTTCCTGGAA CTCAAGCACTTCTCCACACAGAGGAGG ACAGAGCAGACAGCAGAGACC | SEQ ID NO: 619 | Nucleotide sequence of hCEA (Genbank Accession No. M17303) 5' UTR |
| RPADQTVTAALTKRSWNSSTSPQRR TEQTAET | SEQ ID NO: 620 | Amino acid sequence of hCEA 5' UTR alternative reading frame rf0 peptides |
| DQQTRQSQQPQNVPGTQALLHRGG QSRQQRP | SEQ ID NO: 621 | Amino acid sequence of hCEA 5' UTR alternative reading frame rf1 peptides |
| DQQTRQSQQP | SEQ ID NO: 622 | Amino acid sequence of hCEA 5' UTR alternative reading frame rf1 peptide A |
| QNVPGTQALLHRGGQSRQQRP | SEQ ID NO: 623 | Amino acid sequence of hCEA 5' UTR alternative reading frame rf1 peptide B |
| TSRPDSHSSLDKTFLELKHFSTEED RADSRDH | SEQ ID NO: 624 | Amino acid sequence of hCEA 5' UTR alternative reading frame rf2 peptides |
| ACTCTGGAGTGGGAGTGGGAGCGAG CGCTTCTGCGACTCCAGTTGTGAGA GCCGCAAGGGCATGGGAATTGACGC CACTCACCGACCCCCAGTCTCAATC TCAACGCTGTGAGGAAACCTCGACT TTGCCAGGTCCCCAAGGGCAGCGGG GCTCGGCGAGCGAGGCACCCTTCTC CGTCCCCATCCCAATCCAAGCGCTC CTGGCACTGACGACGCCAAGAGACT CGAGTGGGAGTTAAAGCTTCCAGTG AGGGCAGCAGGTGTCCAGGCCGGGC CTGCGGGTTCCTGTTGACGTCTTGC CCTAGGCAAAGGTCCCAGTTCCTTC TCGGAGCCGGCTGTCCCGCGCCACT GGAAACCGCACCTCCCCGCAGC | SEQ ID NO: 625 | Nucleotide sequence of hCYP1B1 (Genbank Accession No. NM_000104) 5' UTR |
| TLEWEWERALLRLQLEPQGHGNR HSPTPSLNLNAVRKPRLCQVPKGSG ARRARHPSPSPSQSKRSWHRRQET RVGVKASSEGSRCPGRACGFLLTSC PRQRSQFLLGAGCPAPLETAPPRS | SEQ ID NO: 626 | Amino acid sequence of hCYPB1 5' UTR alternative reading frame rf0 peptides |
| TLEWEWERALLRLQL | SEQ ID NO: 627 | Amino acid sequence of hCYPB1 5' UTR alternative reading frame rf0 peptide A |
| RHSPTPSLNLNAVRKPRLCQVPKGS GARRARHPSPSPSQSKRSWH | SEQ ID NO: 628 | Amino acid sequence of hCYPB1 5' UTR alternative reading frame rf0 peptide B |
| RRQETRVGVKASSEGSRCPGRACGF LLTSCPRQRSQFLLGAGCPAPLETA PPRS | SEQ ID NO: 629 | Amino acid sequence of hCYPB1 5' UTR alternative reading frame rf0 peptide C |
| LWSGSGSERFCDSSCESRKGMGIDA THRPPVSISTLGNLDFARSPRAAG LGERGTLLRPHPNPSAPGTDDAKRL EWELKLPVRAAGVQAGPAGSCRLA LGKGPSSFSEPAVPRHWKPHLPAA | SEQ ID NO: 630 | Amino acid sequence of hCYPB1 5' UTR alternative reading frame rf1 peptides |

TABLE 29-continued

Alternative Reading Frame Polypeptides Designed
Based upon the 5' Untranslated Regions
of Human Tumor Associated Antigens Disclosed Herein

| Sequence | SEQ ID NO: | Description |
| --- | --- | --- |
| LWSGSGSERFCDSSCESRKGMGIDA THRPPVSISTL | SEQ ID NO: 631 | Amino acid sequence of hCYPB1 5' UTR alternative reading frame rf1 peptide A |
| GNLDFARSPRAAGLGERGTLLRPHP NPSAPGTDDAKRLEWELKLPVRAAG VQAGPAGSC | SEQ ID NO: 632 | Amino acid sequence of hCYPB1 5' UTR alternative reading frame rf1 peptide B |
| RLALGKGPSSFSEPAVPRHWKPHLP AA | SEQ ID NO: 633 | Amino acid sequence of hCYPB1 5' UTR alternative reading frame rf1 peptide C |
| SGVGVGASASATPVVRAARAWELTP LTDPQSQSQRCEETSTLPGPQGQRG SASEAPFSVPIPIQALLALTTPRDS SGSSFQGQQVSRPGLRVPVDVLP AKVPVPSRSRLSRATGNRTSPQH | SEQ ID NO: 634 | Amino acid sequence of hCYPB1 5' UTR alternative reading frame rf2 peptides |
| SGVGVGASASATPVVRAARAWELTP LTDPQSQSQRCEETSTLPGPQGQRG SASEAPFSVPIPIQALLALTTPRDS SGS | SEQ ID NO: 635 | Amino acid sequence of hCYPB1 5' UTR alternative reading frame rf2 peptide A |
| GQQVSRPGLRVPVDVLP | SEQ ID NO: 636 | Amino acid sequence of hCYPB1 5' UTR alternative reading frame rf2 peptide B |
| AKVPVPSRSRLSRATGNRTSPQH | SEQ ID NO: 637 | Amino acid sequence of hCYPB1 5' UTR alternative reading frame rf2 peptide C |
| CCCGCTCTGCTTCAGCGCACGCTGA AGACGGCACTAGGACCCAGGGAAGT CCCCGAGCGGGGTTCGCGGAAAGGC AGCCAGACTCCTCCTTATCTCCAGT GTCAAACTTGACATCAGCCTGCGAG CGGAGCATGGTAACTTCTCCAGCAA TCAGAGCGCTCCCCCTCACATCAGT GGCATGCTTCATGGAGATATGCTCC TCTCACTGCCCTCTGCACCAGCAAC | SEQ ID NO: 638 | Nucleotide sequence of hEphA3 (Genbank Accession No. AF213459) 5' UTR |
| PALLQRTLKTALGPREVPERGSRKG SQTPPYLQCQTHQPASGAWLLQQ SERSPSHQWHASWRYAPLTALCTSN | SEQ ID NO: 639 | Amino acid sequence of hEphA3 5' UTR alternative reading frame rf0 peptides |
| PALLQRTLKTALGPREVPERGSRKG SQTPPYLQCQT | SEQ ID NO: 640 | Amino acid sequence of hEphA3 5' UTR alternative reading frame rf0 peptide A |
| LLQQSERSPSHQWHASWRYAPLTAL CTSN | SEQ ID NO: 641 | Amino acid sequence of hEphA3 5' UTR alternative reading frame rf0 peptide B |
| PLCFSARRRHDPGKSPSGVRGKA ARLLLISSVKLDISLRAEHGNFSSN QSAPPHISGMLHGDMLLSLPSAPAT | SEQ ID NO: 642 | Amino acid sequence of hEphA3 5' UTR alternative reading frame rf1 peptides |
| DPGKSPSGVRGKAARLLLISSVKLD ISLRAEHGNFSSNQSAPPHISGMLH GDMLLSLPSAPAT | SEQ ID NO: 643 | Amino acid sequence of hEphA3 5' UTR alternative reading frame rf1 peptide A |
| RSASAHAEDGTRTQGSPRAGFAERQ PDSSLSPVSNLTSACERSMVTSPAI RALPLTSVACFMEICSSHCPLHQQH | SEQ ID NO: 644 | Amino acid sequence of hEphA3 5' UTR alternative reading frame rf2 peptides |
| AATTCTCGAGCTCGTCGACCGGTCG ACGAGCTCGAGGGTCGACGAGCTCG AGGGCGCGCCCGGCCCCCACCCC TCGCAGCACCCCGCGCCCCGCGCCC TCCCAGCCGGGTCCAGCCGGAGCCA TGGGGCCGGAGCCGCAGTGAGCACC | SEQ ID NO: 645 | Nucleotide sequence of hHER2 (Genbank Accession No. M_11730) 5' UTR |
| NSRARRPVDELEGRRARGRAPGPHP SQHPAPRALPAGSSRSHGAGAAVST | SEQ ID NO: 646 | Amino acid sequence of hHER2 5' UTR alternative reading frame rf0 peptides |

TABLE 29-continued

Alternative Reading Frame Polypeptides Designed
Based upon the 5' Untranslated Regions
of Human Tumor Associated Antigens Disclosed Herein

| Sequence | SEQ ID NO: | Description |
| --- | --- | --- |
| ILELVDRSTSSRVDELEGARPAPTPRSTPRPAPSQPGPAGAMGPEPQAP | SEQ ID NO: 647 | Amino acid sequence of hHER2 5' UTR alternative reading frame rf1 peptides |
| ILELVDRSTSSRVDELEGARPAPTPRSTPRPAPSQPGPAGAMGPEPQ | SEQ ID NO: 648 | Amino acid sequence of hHER2 5' UTR alternative reading frame rf1 peptide A |
| FSSSSTGRRARGSTSSRARARPPPLAAPRAPRPPSRVQPEPWGRSRSEHH | SEQ ID NO: 649 | Amino acid sequence of hHER2 5' UTR alternative reading frame rf2 peptides |
| CCTACTCTATTCAGATATTCTCCAGATTCCTAAAGATTAGAGATCATTTCTCATTCTCCTAGGAGTACTCACTTCAGGAAGCAACCAGATAAAAGAGAGGTGCAACGGAAGCCAGAACATTCCTCCTGGAAATTCAACCTGTTTCGCAGTTTCTCGAGGAATCAGCATTCAGTCAATCCGGGCCGGGAGCAGTCATCTGTGGTGAGGCTGATTGGCTGGGCAGGAACAGCGCCGGGGCGTGGGCTGAGCACAGCGCTTCGCTCTCTTTGCCACAGGAAGCCTGAGCTCATTCGAGTAGCGGCTCTTCCAAGCTCAAAGAAGCAGAGGCCGCTGTTCGTTTCCTTTAGGTCTTTCCACTAAAGTCGGAGTATCTTCTTCCAAGATTTCACGTCTTGGTGGCCGTTCCAAGGAGCGCGAGGTCGGG | SEQ ID NO: 650 | Nucleotide sequence of hMDR1 (Genbank Accession No. M_14758) 5' UTR |
| LLYSDILQIPKDRSFLILLGVLTSGSNQIKERCNGSQNIPPGNSTCFAVSRGISIQSIRAGSSHLWGLAGQEQRRGVGAQRFALFATGSLSSFERLFQAQRSRGRCSFPLGLSTKVGVSSSKISRLGGRSKEREVG | SEQ ID NO: 651 | Amino acid sequence of hMDR1 5' UTR alternative reading frame rf0 peptides |
| LLYSDILQIPKD | SEQ ID NO: 652 | Amino acid sequence of hMDR1 5' UTR alternative reading frame rf0 peptide A |
| RSFLILLGVLTSGSNQIKERCNGSQNIPPGNSTCFAVSRGISIQSIRAGSSHLW | SEQ ID NO: 653 | Amino acid sequence of hMDR1 5' UTR alternative reading frame rf0 peptide B |
| LAGQEQRRGVG | SEQ ID NO: 654 | Amino acid sequence of hMDR1 5' UTR alternative reading frame rf0 peptide C |
| AQRFALFATGSLSSFE | SEQ ID NO: 655 | Amino acid sequence of hMDR1 5' UTR alternative reading frame rf0 peptide D |
| RLFQAQRSRGRCSFPLGLSTKVGVSSSKISRLGGRSKEREVG | SEQ ID NO: 656 | Amino acid sequence of hMDR1 5' UTR alternative reading frame rf0 peptide E |
| YSIQIFSRFLKIRDHFSFSEYSLQEATRKRGATEARTFLLEIQPVSQFLEESAFSQSGPGAVICGEADWLGRNSAGAWAEHSASLSLPQEAAHSSSGSSKLKEAEAAVRFLVFPLKSEYLLPRFHVLVAVPRSARSG | SEQ ID NO: 657 | Amino acid sequence of hMDR1 5' UTR alternative reading frame rf1 peptides |
| YSIQIFSRFLKIRDHFSFS | SEQ ID NO: 658 | Amino acid sequence of hMDR1 5' UTR alternative reading frame rf1 peptide A |
| EYSLQEATR | SEQ ID NO: 659 | Amino acid sequence of hMDR1 5' UTR alternative reading frame rf1 peptide B |
| KRGATEARTFLLEIQPVSQFLEESAFSQSGPGAVICGEADWLGRNSAGAWAEHSASLSLPQEA | SEQ ID NO: 660 | Amino acid sequence of hMDR1 5' UTR alternative reading frame rf1 peptide C |

TABLE 29-continued

Alternative Reading Frame Polypeptides Designed
Based upon the 5' Untranslated Regions
of Human Tumor Associated Antigens Disclosed Herein

| Sequence | SEQ ID NO: | Description |
| --- | --- | --- |
| AHSSSGSSKLKEAEAAVRFL | SEQ ID NO: 661 | Amino acid sequence of hMDR1 5' UTR alternative reading frame rf1 peptide D |
| VFPLKSEYLLPRFHVLVAVPRSARSG | SEQ ID NO: 662 | Amino acid sequence of hMDR1 5' UTR alternative reading frame rf1 peptide E |
| PTLFRYSPDSRLEIISHSPRSTHFRKQPDKREVQRKPEHSSWKFNLFRSFSRNQHSVNPGREQSSVVRLIGWAGTAPGRGLSTALRSLCHRKPELIRVAALPSSKKQRPLFVSFRSFHSRSIFFQDFTSWWPFQGARGRD | SEQ ID NO: 663 | Amino acid sequence of hHER2 5' UTR alternative reading frame rf2 peptides |
| PTLFRYSPDS | SEQ ID NO: 664 | Amino acid sequence of hHER2 5' UTR alternative reading frame rf2 peptide A |
| RLEIISHSPRSTHFRKQPDKREVQRKPEHSSWKFNLFRSFSRNQHSVNPGREQSSVVRLIGWAGTAPGRGLSTALRSLCHRKPELIRVAALPSSKKQRPLFVSFRSFH | SEQ ID NO: 665 | Amino acid sequence of hHER2 5' UTR alternative reading frame rf2 peptide B |
| SRSIFFQDFTSWWPFQGARGRD | SEQ ID NO: 666 | Amino acid sequence of hHER2 5' UTR alternative reading frame rf2 peptide C |
| GTCCAGGAGCAGGTAGCTGCTGGGCTCCGGGGACACTTTGCGTTCGGGCTGGGAGCGTGCTTTCCACGACGGTGACACGCTTCCCTGGATTGGCAGCCAGACTGCCTTCCGGGTCACTGCC | SEQ ID NO: 667 | Nucleotide sequence of hP53 (Genbank Accession No. M_14495) 5' UTR |
| XSRSRLLGSGDTLRSGWERAFHDGDTLPWIGSQTAFRVTA | SEQ ID NO: 668 | Amino acid sequence of hP53 5' UTR alternative reading frame rf0 peptides |
| LLGSGDTLRSGWERAFHDGDTLPWIGSQTAFRVTA | SEQ ID NO: 669 | Amino acid sequence of hP53 5' UTR alternative reading frame rf0 peptide A |
| PGAGSCWAPGTLCVRAGSVLSTTVTRFPGLAARLPSGSLP | SEQ ID NO: 670 | Amino acid sequence of hP53 5' UTR alternative reading frame rf1 peptides |
| VQEQVAAGLRGHFAFGLGACFPRRHASLDWQPDCLPGHCH | SEQ ID NO: 671 | Amino acid sequence of hP53 5' UTR alternative reading frame rf2 peptides |
| VQEQVAAGLRGHFAFGLGACFPRR | SEQ ID NO: 672 | Amino acid sequence of hP53 5' UTR alternative reading frame rf2 peptide A |
| HASLDWQPDCLPGHCH | SEQ ID NO: 673 | Amino acid sequence of hP53 5' UTR alternative reading frame rf2 peptide B |
| GCTTCAGGGTACAGCTCCCCCGCAGCCAGAAGCCGGGCCTGCAGCCCCTCAGCACCGCTCCGGGACACCCCACCCGCTTCCCAGGCGTGACCTGTCAACAGCAACTTCGCGGTGTGGTGAACTCTCTGAGGAAAAACCATTTTGATTATTACTCTCAGACGTGCGTGGCAACAAGTGACTGAGACCTAGAAATCCAAGCGTTGGAGGTCCTGAGGCCAGCCTAAGTCGCTTCAAA | SEQ ID NO: 674 | Nucleotide sequence of hPRAME (Genbank Accession No. U65011) 5' UTR |
| LQGTAPPQPEAGPAAPQHRSGTPHPLPRRDLSTATSRCGELSEEKPFLLLSDVRGNKLRPRNPSVGGPEASLSRFK | SEQ ID NO: 675 | Amino acid sequence of hPRAME 5' UTR alternative reading frame rf0 peptides |

TABLE 29-continued

Alternative Reading Frame Polypeptides Designed
Based upon the 5' Untranslated Regions
of Human Tumor Associated Antigens Disclosed Herein

| Sequence | SEQ ID NO: | Description |
| --- | --- | --- |
| LQGTAPPQPEAGPAAPQHRSGTPHP LPRRDLSTATSRCGELSEEKPF | SEQ ID NO: 676 | Amino acid sequence of hPRAME 5' UTR alternative reading frame rf0 peptide A |
| LLLSDVRGNK | SEQ ID NO: 677 | Amino acid sequence of hPRAME 5' UTR alternative reading frame rf0 peptide B |
| LRPRNPSVGGPEASLSRFK | SEQ ID NO: 678 | Amino acid sequence of hPRAME 5' UTR alternative reading frame rf0 peptide C |
| FRVQLPRSQKPGLQPLSTAPGHPTR FPGVTCQQQLRGVVNSLRKNHFDYY SQTCVATSDDLEIQALEVLRPAV ASK | SEQ ID NO: 679 | Amino acid sequence of hPRAME 5' UTR alternative reading frame rf1 peptides |
| FRVQLPRSQKPGLQPLSTAPGHPTR FPGVTCQQQLRGVVNSLRKNHFDYY SQTCVATSD | SEQ ID NO: 680 | Amino acid sequence of hPRAME 5' UTR alternative reading frame rf1 peptide A |
| DLEIQALEVLRPA | SEQ ID NO: 681 | Amino acid sequence of hPRAME 5' UTR alternative reading frame rf1 peptide B |
| ASGYSSPAARSRACSPSAPLRDTPP ASQAPVNSNFAVWTLGKTILII TLRRAWQQVTETKSKRWRSGQPK SLQN | SEQ ID NO: 682 | Amino acid sequence of hPRAME 5' UTR alternative reading frame rf2 peptides |
| ASGYSSPAARSRACSPSAPLRDTPP ASQA | SEQ ID NO: 683 | Amino acid sequence of hPRAME 5' UTR alternative reading frame rf2 peptide A |
| PVNSNFAVW | SEQ ID NO: 684 | Amino acid sequence of hPRAME 5' UTR alternative reading frame rf2 peptide B |
| GKTILIITLRRAWQQVTET | SEQ ID NO: 685 | Amino acid sequence of hPRAME 5' UTR alternative reading frame rf2 peptide C |
| CTCAAAAGGGGCCGGATTTCCTTCT CCTGGAGGCAGATGTTGCCTCTCTC TCTCGCTCGGATTGGTTCAGTGCAC TCTAGAAACACTGCTGTGGTGGAGA AACTGGACCCCAGGTCTGGAGCGAA TTCCAGCCTGCAGGGCTGATAAGCG AGGCATTAGTGAGATTGAGAGAGAC TTTACCCCGCCGTGGTGGTTGGAGG GCGCGCAGTAGAGCAGCAGCACAGG CGCGGGTCCCGGGAGGCCGGCTCTG CTCGCGCCGAG | SEQ ID NO: 686 | Nucleotide sequence of hPSMA (Genbank Accession No. NM004476) 5' UTR |
| LKRGRISFSWRQMLPLSLARIGSVH SRNTAVVEKLDPRSGANSSLQGA RHDERLYPAVVVGGRAVEQQHR RGSREAGSARAE | SEQ ID NO: 687 | Amino acid sequence of hPSMA 5' UTR alternative reading frame rf0 peptides |
| LKRGRISFSWRQMLPLSLARIGSVH SRNTAVVEKLDPRSGANSSLQG | SEQ ID NO: 688 | Amino acid sequence of hPSMA 5' UTR alternative reading frame rf0 peptide A |
| ERLYPAVVVGGRAVEQQHRRGSREA GSARAE | SEQ ID NO: 689 | Amino acid sequence of hPSMA 5' UTR alternative reading frame rf0 peptide B |
| SKGAGFPSPGGRCCLSLSLGLVQCT LETLLWWRNWTPGLERIPACRADKR GISEIERDFTPPWWLEGAQSSSTG AGPGRPALLAPR | SEQ ID NO: 690 | Amino acid sequence of hPSMA 5' UTR alternative reading frame rf1 peptides |
| SKGAGFPSPGGRCCLSLSLGLVQCT LETLLWWRNWTPGLERIPACRADKR GISETERDFTPPWWLEGAQ | SEQ ID NO: 691 | Amino acid sequence of hPSMA 5' UTR alternative reading frame rf1 peptide A |

TABLE 29-continued

Alternative Reading Frame Polypeptides Designed
Based upon the 5' Untranslated Regions
of Human Tumor Associated Antigens Disclosed Herein

| Sequence | SEQ ID NO: | Description |
| --- | --- | --- |
| SSSTGAGPGRPALLAPR | SEQ ID NO: 692 | Amino acid sequence of hPSMA 5' UTR alternative reading frame rf1 peptide B |
| QKGPDFLLLEADVASLSRSDWFSAL KHCCGGETGPQVWSEFQPAGLISE ALVRLRETLPRRGGWRARSRAAAQA RVPGGRLCSRRD | SEQ ID NO: 693 | Amino acid sequence of hPSMA 5' UTR alternative reading frame rf2 peptides |
| QKGPDFLLLEADVASLSRSDWFSAL | SEQ ID NO: 694 | Amino acid sequence of hPSMA 5' UTR alternative reading frame rf2 peptide A |
| KHCCGGETGPQVWSEFQPAGLISEA LVRLRETLPRRGGWRARSRAAAQAR VPGGRLCSRRD | SEQ ID NO: 695 | Amino acid sequence of hPSMA 5' UTR alternative reading frame rf2 peptide B |
| CGCAGCCTCCAAAGCCGCCTTCCTC AGGGAAATTTGCGTGACCTTACTGC CCTCCGTCTACAGGCCTTGTACCTC TCCAGGCCGATTTTCCACAATTTA AATCCCAGTTCACCTGGTATCCAGC TCCAGCAACTTAGAGCGTTTCACGT CACGCCGGGCGCCAGGCGTCGGCTT GTATAACCTGAAAACGCTCCTGTTT TTCTCATCTGTGCAGTGGGTTTTGA TTCCCACC | SEQ ID NO: 696 | Nucleotide sequence of hRCAS1 (Genbank Accession No. AF006265) 5' UTR |
| QPPKPPSSGKFAPYCPPSTGLVPL QADFSTIIPVHLVSSSSNLERFTS RRAPGVGLYNLKTLLFFSSVQWVLI PT | SEQ ID NO: 697 | Amino acid sequence of hRCAS1 5' UTR alternative reading frame rf0 peptides |
| QPPKPPSSGKFA | SEQ ID NO: 698 | Amino acid sequence of hRCAS1 5' UTR alternative reading frame rf0 peptide A |
| PYCPPSTGLVPLQADFSTI | SEQ ID NO: 699 | Amino acid sequence of hRCAS1 5' UTR alternative reading frame rf0 peptide B |
| IPVHLVSSSSNLERFTSRRAPGVG LYNLKTLLFFSSVQWVLIPT | SEQ ID NO: 700 | Amino acid sequence of hRCAS1 5' UTR alternative reading frame rf0 peptide C |
| RSLQSRLPQGNLRDLTALRLQALYL SRPIFPQFKSQFTWYPAPATSVSR HAGRQASACITKRSCFSHLCSGF FPP | SEQ ID NO: 701 | Amino acid sequence of hRCAS1 5' UTR alternative reading frame rf1 peptides |
| RSLQSRLPQGNLRDLTALRLQALYL SRPIFPQFKSQFTWYPAPAT | SEQ ID NO: 702 | Amino acid sequence of hRCAS1 5' UTR alternative reading frame rf1 peptide A |
| SVSRHAGRQASACIT | SEQ ID NO: 703 | Amino acid sequence of hRCAS1 5' UTR alternative reading frame rf1 peptide B |
| KRSCFSHLCSGF | SEQ ID NO: 704 | Amino acid sequence of hRCAS1 5' UTR alternative reading frame rf1 peptide C |
| AASKAAFLREICVTLLPSVYRPCTS PGRFFHNLNPSSPGIQLQQLRAFHV TPGARRRLVPENAPVFLICAVGFD SHH | SEQ ID NO: 705 | Amino acid sequence of hRCAS1 5' UTR alternative reading frame rf2 peptides |
| AASKAAFLREICVTLLPSVYRPCTS PGRFFHNLNPSSPGIQLQQLRAFHV TPGARRRLV | SEQ ID NO: 706 | Amino acid sequence of hRCAS1 5' UTR alternative reading frame rf2 peptide A |
| PENAPVFLICAVGFDSHH | SEQ ID NO: 707 | Amino acid sequence of hRCAS1 5' UTR alternative reading frame rf2 peptide B |
| GGCACGAGAGCTTACAGCCTGAGAA GAGCGTCTCGCCCGGGAGCGGCGGC GGCCATCGAGACCCAACCCCAAGGC | SEQ ID NO: 708 | Nucleotide sequence of hSGA-1M (Genbank Accession |

TABLE 29-continued

Alternative Reading Frame Polypeptides Designed
Based upon the 5' Untranslated Regions
of Human Tumor Associated Antigens Disclosed Herein

| Sequence | SEQ ID NO: | Description |
|---|---|---|
| GCGTCCCCCTCGGCCTCCCAGCGCT CCCAAGCCGCAGCGGCCGCGCCCCT TCAGCTAGCTCGCTCGCTCGCTCTG CTTCCCTGCTGCCGGCTGCGCC | | No. AY192728) 5' UTR |
| ARELTAEERLARERRRPSRPNPKA RPPRPPSAPKPQRPRPFSLARSLC FPAAGCA | SEQ ID NO: 709 | Amino acid sequence of hSGA-1M 5' UTR alternative reading frame rf0 peptides |
| EERLARERRRPSRPNPKARPPRPPS APKPQRPRPFS | SEQ ID NO: 710 | Amino acid sequence of hSGA-1M 5' UTR alternative reading frame rf0 peptide A |
| LARSLCFPAAGCA | SEQ ID NO: 711 | Amino acid sequence of hSGA-1M 5' UTR alternative reading frame rf0 peptide B |
| HESLQPEKSVSPGSGGGHRDPTPRR VPLGLPALPSRSGRAPSASSLARSA SLLPAAP | SEQ ID NO: 712 | Amino acid sequence of hSGA-1M 5' UTR alternative reading frame rf1 peptides |
| GTRAYSLRRASRPGAAAAIETQPQG ASPSASQRSQAAAAAPLQLARSLAL LPCCRLRH | SEQ ID NO: 713 | Amino acid sequence of hSGA-1M 5' UTR alternative reading frame rf2 peptides |
| GCAGCGCTGCGTCCTGCTGCGCACG TGGGAAGCCCTGGCCCCGGCCACCC CCGCG | SEQ ID NO: 714 | Nucleotide sequence of hTERT (Genbank Accession No. NM_003219) 5' UTR |
| QRCVLLRTWEALAPATPA | SEQ ID NO: 715 | Amino acid sequence of hTERT 5' UTR alternative reading frame rf0 peptides |
| SAASCCARGKPWPRPPPR | SEQ ID NO: 716 | Amino acid sequence of hTERT 5' UTR alternative reading frame rf1 peptides |
| AALRPAAHVGSPGPGHPRD | SEQ ID NO: 717 | Amino acid sequence of hTERT 5' UTR alternative reading frame rf2 peptides |
| AAGAAAATCCTGCTTCACAAAAACC GTCACTTAGGAAAAGATG | SEQ ID NO: 718 | Nuclotide sequence of hTRP-P8 (Genbank Accession No. NM_024080) 5' UTR |
| RKSCLTKTVTEKM | SEQ ID NO: 719 | Amino acid sequence of hTRP-P8 5' UTR alternative reading frame rf0 peptides |
| RKSCLTKTVT | SEQ ID NO: 720 | Amino acid sequence of hTRP-P8 5' UTR alternative reading frame rf0 peptide A |
| ENPAQKPSLRKR | SEQ ID NO: 721 | Amino acid sequence of hTRP-P8 5' UTR alternative reading frame rf1 peptides |
| KKILLDKNRHLGKD | SEQ ID NO: 722 | Amino acid sequence of hTRP-P8 5' UTR alternative reading frame rf2 peptides |
| GGGGTAAGGAGTTCAAGGCAGCGCC CACACCCGGGGGCTCTCCGCAACCC GACCGCCTGTCCGCTCCCCCACTTC CCGCCCTCCCTCCCACCTACTCATT CACCCACCCACCCACCCAGAGCCGG GACGGCAGCCCAGGCGCCCGGGCCC CGCCGTCTCCTCGCCGCGATCCTGG ACTTCCTCTTGCTGCAGGACCCGGC TTCCACGTGTGTCCCGGAGCCGGCG TCTCAGCACACGCTCCGCTCCGGGC CTGGGTGCCTACAGCAGCCAGAGCA GCAGGGAGTCCGGGACCCGGGCGGC ATCTGGGCCAAGTTAGGCGCCGCCG | SEQ ID NO: 723 | Nucleotide sequence of hWTI (Genbank Accession No. NM_000378) 5' UTR |

TABLE 29-continued

Alternative Reading Frame Polypeptides Designed
Based upon the 5' Untranslated Regions
of Human Tumor Associated Antigens Disclosed Herein

| Sequence | SEQ ID NO: | Description |
|---|---|---|
| AGGCCAGCGCTGAACGTCTCCAGGG CCGGAGGAGCCGCGGGGCGTCCGGG TCTGAGCCTCAGCAA | | |
| GVRSSRQRPHPGALRNPTACPLPHF PPSLPPTHSPTHPPRAGTAAQAPGP RRLLAAILDFLLLQDPASTCVPEPA SQHTLRSGPGCLQQPEQQGVRDPGG IWAKLGAAEASAERLQGRRSRGASG SEPQQ | SEQ ID NO: 724 | Amino acid sequence of hWTI 5' UTR alternative reading frame rf0 peptides |
| XGGVQGSAHTRGLSATRPPVRSPT SRPPSHLLIHPPTHPEPGRQPRRPG PAVSSPRSWTSSCCRTRLPRVSRSR RLSTRSAPGLGAYSSQSSRESGTRA ASGPSAPPRPALNVSRAGGAAGRP GLSLSK | SEQ ID NO: 725 | Amino acid sequence of hWTI 5' UTR alternative reading frame rf1 peptides |
| GVQGSAHTRGLSATRPPVRSPTSRP PSHLLIHTPPTHPEPGRQPRRPGPAV SSPRSWTSSCCRTRLPRVSRSRRLS TRSAPGLGAYSSQSSRESGTRAASG PS | SEQ ID NO: 726 | Amino acid sequence of hWTI 5' UTR alternative reading frame rf1 peptide A |
| APPRPALNVSRAGGAAGRPGLSLSK | SEQ ID NO: 727 | Amino acid sequence of hWTI 5' UTR alternative reading frame rf1 peptide B |
| GKEFKAAPTPGGSPQPDRLSAPPLP ALPPTYSFTHPPTQSRDGSPGARAP PSPRRDPGLPLAAGPGFHVCPGAGV SAHAPLRAWVPTAARAAGSPGPGRH LGQVRRRGQRTSPGPEEPRGVRV ASAN | SEQ ID NO: 728 | Amino acid sequence of hWTI 5' UTR alternative reading frame rf2 peptides |
| GKEFKAAPTPGGSPQPDRLSAPPLP ALPPTYSFTHPPTQSRDGSPGARAP PSPRRDPGLPLAAGPGFHVCPGAGV SAHAPLRAWVPTAARAAGSPGPGRH LGQVRRRGQR | SEQ ID NO: 729 | Amino acid sequence of hWTI 5' UTR alternative reading frame rf2 peptide A |
| TSPGPEEPRGVRV | SEQ ID NO: 730 | Amino acid sequence of hWTI 5' UTR alternative reading frame rf2 peptide B |

EXAMPLE 25

Plasmid Constructs and Tumor Cell Lines for Expressing HER-2

This Example discloses the construction of plasmid vectors and tumor cell lines for the expression of human HER-2 and HER-2 fusion proteins.

Full-length human HER-2 was cloned from a SK-BR3 cell line according to methods known in the art (see, PCT Patent Application Publication No. WO 01/74855) and cloned into the MIRB and pCR3.1 expression vectors (Naski et al., Nat. Genet 13:233-237 (1996) and Invitrogen, (Carlsbad, Calif.), respectively). The MIRB vector has a multiple cloning site followed by an IRES neoR gene for selection of transfected cells with neomycin.

The hHER-2/E14 tumor cell line was generated by transfecting the mouse EL4 thymoma cell line (ATCC No. TIB-39, Rockville, Md.) with full-length human HER-2 cDNA cloned into the MIRB vector. The hHER-2/B16 tumor cell line was generated by transfecting the mouse B16 melanoma cell line (ATCC No. CRL-6322, Rockville, Md.) with full-length human HER-2 cDNA cloned into the pCR3.1 vector.

HER500•rGM-CSF is a recombinant fusion protein comprising an amino-terminal 32 amino acid signal sequence from human prostatic acid phosphatase (hPAP; Genbank Accession No. NM_001099 amino acids 1-32); a 3 amino acid sequence of the mature hPAP protein (Genbank Accession No. NM_001099 amino acids 33-35); an Ala-Arg linker; a 3 amino acid hHER-2 signal sequence (Genbank Accession No. M11730 amino acids 19-21); 289 amino acids of the mature hHER-2 membrane distal extracellular domain (Genbank Accession No. M11730 amino acids 22-310); an Ala linker; the OVA-derived immunodominant octapeptide SIINFEKL (OVA$_{25-264}$); 217 amino acids of the hHER-2 membrane distal intracellular domain (Genbank Accession No. M11730 amino acids 1038-1254); the coding sequence for mature rat GM-CSF (Genbank Accession No. U00620 amino acids 1-127); and a C-terminal affinity tag consisting of GAPPPPAHHHHHH. Construction of HER500•rGM-CSF is disclosed in PCT Patent Application Publication No. WO 01/74855, incorporated herein by reference in its entirety. The polynucleotide sequence of HER500-rGM-CSF is presented herein as SEQ ID NO: 13, which corresponds to Genbank Accession No. AX268288.

The cDNA encoding human GM-CSF (hGM-CSF) was amplified by PCR from first strand cDNA made from mRNA isolated from human peripheral blood mononuclear cells (PBMNC). The primer used in the PCR reaction delineate nucleotides 60 to 440 of GenBank Acc. No. NM_000758 and introduce an exogenous BamHI site directly 5' to the mature hGM and an XbaI site 3' of the of the native stop codon. The resulting fragment was digested with the appropriate restriction enzymes and cloned into the vector pCR3.1 (Invitrogen, Carlsbad, Calif.), resulting in plasmid hGM-pCR3.1. A derivative of mature hGM-CSF was made by PCR using primers that introduce a BamHI site 5' to the coding region for mature hGM-CSF and four consecutive prolines immediately 3' to the mature hGM-CSF. This amplified fragment of hGM-CSF was restricted with the appropriate enzymes and ligated to a plasmid pCR3.1 derivative in frame with six consecutive histidines followed by a stop codon, resulting in plasmid hGMPH6-pCR3.2. The HER500 gene was ligated in frame with hGMPH6 gene, resulting plasmid HER500hGMPH6-pCR3.2. Plasmid HER500hGMPH6-pCR3.2 encodes, in the 5' to 3' direction: a 32 amino acid PAP signal sequence (amino acids 1 to 32 of GenBank Acc NM_001099), a 3 amino acid sequence of the mature PAP protein (amino acids 33 to 35 of GenBank Acc NM_001099), a Ala Arg linker, 3 amino acids of HER2 signal sequence (amino acids 19 to 21 of GenBank Acc No. M11730), 289 amino acids of mature HER2 membrane distal extracellular domain (amino acids 22 to 310 of GenBank Acc M11730), 217 amino acids of the membrane distal intracellular HER2 domain (amino acids 1038 to 1254 of GenBank Acc M11730), a 127 amino acid mature human GM-CSF sequence (amino acids 18 to 144 GenBank Acc NM-000758) and a C-terminal tag consisting of Gly Ala Pro Pro Pro Pro Ala Ala Ala His His His His His His (SEQ ID NO: 737).

HER300 is a recombinant fusion protein comprising the 32 amino acid hPAP signal sequence (Genbank Accession No. NM_001099 amino acids 1-32); the 3 amino acid sequence of the mature hPAP protein (Genbank Accession No. NM_001099 amino acids 33-35); an Ala-Arg linker; the 3 amino acid hHER-2 signal sequence (Genbank Accession No. M11730 amino acids 19-21); 289 amino acids of the mature HER-2 membrane distal extracellular domain (Genbank Accession No. M11730 amino acids 22-310); an Ala linker; OVA$_{257-264}$; and an AAAHHHHHH (SEQ ID NO: 738) C-terminal affinity tag. The polynucleotide sequence of HER300 is presented herein as SEQ ID NO: 14.

Expression vectors comprising the coding sequence for various HER-2 fusion proteins were used for baculovirus mediated transfection of insect SF21 cells (Clontech, Palo Alto, Calif.). Fusion protein products were recovered from the tissue culture supernatants and affinity purified by passage over a metal affinity column (NTA resin, Qiagen, Valencia, Calif.).

HER-2 fusion proteins comprising rat GM-CSF were tested for GM-CSF bioactivity using the proliferative response of GM-NFS-60 cells, a GM-CSF dependent cell line. The presence of HER-2 was verified using HER-2-specific mAb in Western blot analysis according to standard methods. Protein concentrations were determined by BCA assay (Pierce, Rockford, Ill.).

EXAMPLE 26

Immunizations

This Example discloses the immunization of mice with HER-2 loaded, activated dendritic cells (DC).

Enriched activated dendritic cells (DCs) were prepared as described (Laus et al., *Nature Biotechnology* 18:1269-1272 (2000)). Briefly, enriched preparations of activated DC were prepared by incubating female C57BL/6 spleen cells in tissue culture flasks for 2 h at 37° C., removing non-adherent cells, and subsequently culturing the remaining adherent cells for two days in the presence of 1 µM ionomycin (Sigma, St. Louis, Mo.). DC obtained in this manner were pulsed by sixteen hour co-culture with each of the indicated HER-2 ARF polypeptide pools or HER-2 fusion proteins in 1 µM ionomycin, washed two times and injected intraperitoneally (i.p.) into the C57BL/6 mice ($2.5 \times 10^5$ cells per mouse). Two weeks after the last immunization, mice were challenged with a single i.p. injection of hHER-2/EL4 cells or hHER-2/B 16 cells in 0.1 ml PBS. Mice were monitored daily and their survival recorded.

EXAMPLE 27

DNA Sequencing

Genomic DNA was prepared from EL4 cells stably transfected with MIRB or pCR3.1 plasmids encoding HER-2/neu cDNA. DNA was isolated from cultured animal cells using the DNeasy kit according to the manufacturer's protocol (Qiagen Inc. Valencia, Calif.).

Fragments of genomic DNA encoding the junction of CMV promoter and HER-2/neu 5'ORF were synthesized by PCR using 200 ng of genomic DNA as template with the following primers: CMV forward primers A) 5'-TACGG-TAAACTGCCCACTTGG (SEQ ID NO: 290), B) 5'-AAAT-GTCGTAACAACTCCGCCC (SEQ ID NO: 291); and HER-2/neu reverse primers C) 5'-CTTGCAGCCAGCAAACTCCTGGATATTGG (SEQ ID NO: 292) and D) 5'-GCACAGGGCTTGCTGCACTTCT-CACACC (SEQ ID NO: 293). Amplified fragments were excised from agarose gels and purified using Qiagen gel purification kit. DNA sequence was determined by automated fluorescent sequencing using an ABI373 and sequences were analyzed with the Sequencher software and compared to the NCBI database.

EXAMPLE 28

Cell Lines Expressing mTERT

Western Blot and RT-PCR Analysis $6 \times 10^6$ EL4, B16, and HeLa cells were lysed in 0.1 ml of 4° C. 25 mM Tris, 5 mM EDTA, 600 mM NaCl, 10% glycerol, 0.01 mM DTT, 0.1% NP-40, 1:1000 protease inhibitor cocktail III pH 8.0 (Calbiochem-Novabiochem Corp., San Diego, Calif.). Supernatants from cell lysis were subjected to SDS-PAGE followed by Western blotting using an anti-TERT polyclonal antibody (Oncogene Research Products, San Diego, Calif.).

The following two oligonucleotides were utilized for RT-PCR analysis of mTert mRNA expression in EL4 and B16 cell lines: (1) Forward 5'-CCTCATTCCTACTCAGCAACCTC-CAGCC (SEQ ID NO: 522) and (2) Reverse 5'-GTCCAT-CAGCCAGAACAGGAACGTAGCC (SEQ ID NO: 523). The following two reference oligonucleotides were included for murine HPRT: (1) Forward 5'-GTTGGATACAGGCCA-GACTTTGTTG (SEQ ID NO: 524) and (2) Reverse 5'-GAGGGTAGGCTGGCCTATAGGCT (SEQ ID NO: 525). Reiner et al., *J. Immulol. Meth.* 165:37 (1993). Total RNA was extracted from $5 \times 10^6$ cells using RNeasy kit (Qiagen) following manufacturers directions. 2.5 µg of total RNA was treated with DNAse I (ProMega) to remove any contaminating genomic DNA, and 1 µg of treated total RNA was converted to cDNA using Superscript II reverse transcriptase (Invitrogen), and then used for PCR with HPRT or mTert primers.

EXAMPLE 29

Prevention of In Vivo Tumor Growth by Pre-Immunization with HER-2 Alternative Reading Frame Antigen-Pulsed Dendritic Cells This Example discloses the protective anti-tumor efficacy of dendritic cells loaded ex vivo with human HER-2 ARF polypeptide pools.

Figure 1A:
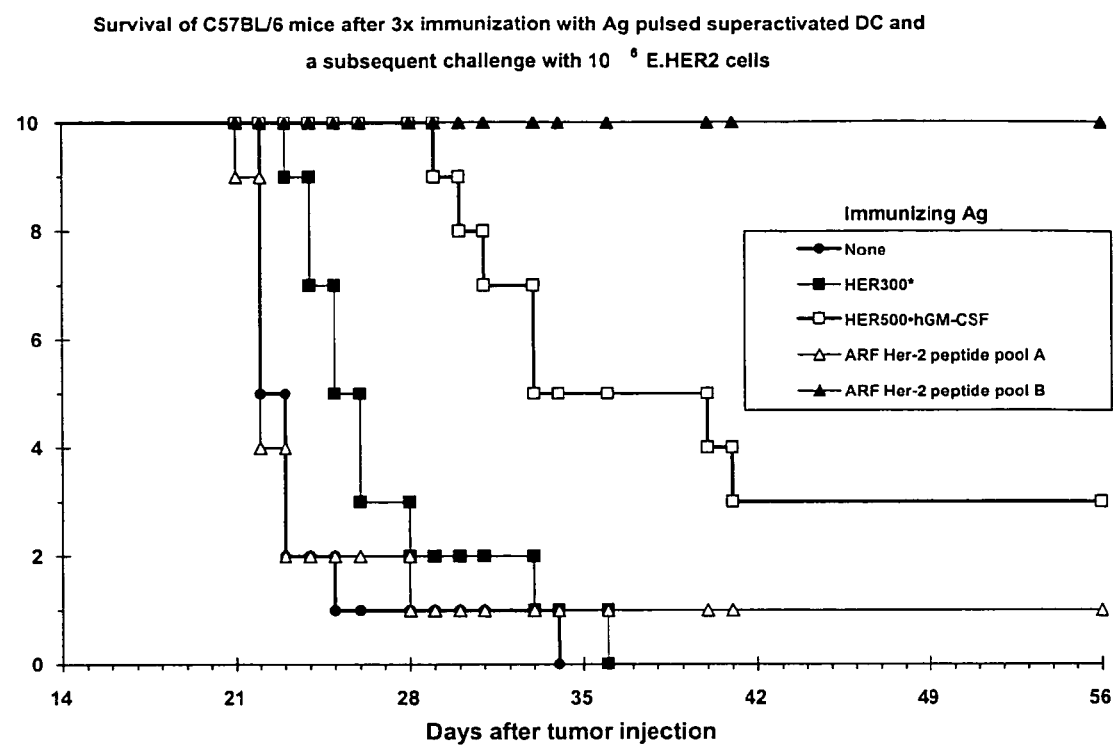
Figure 1B:
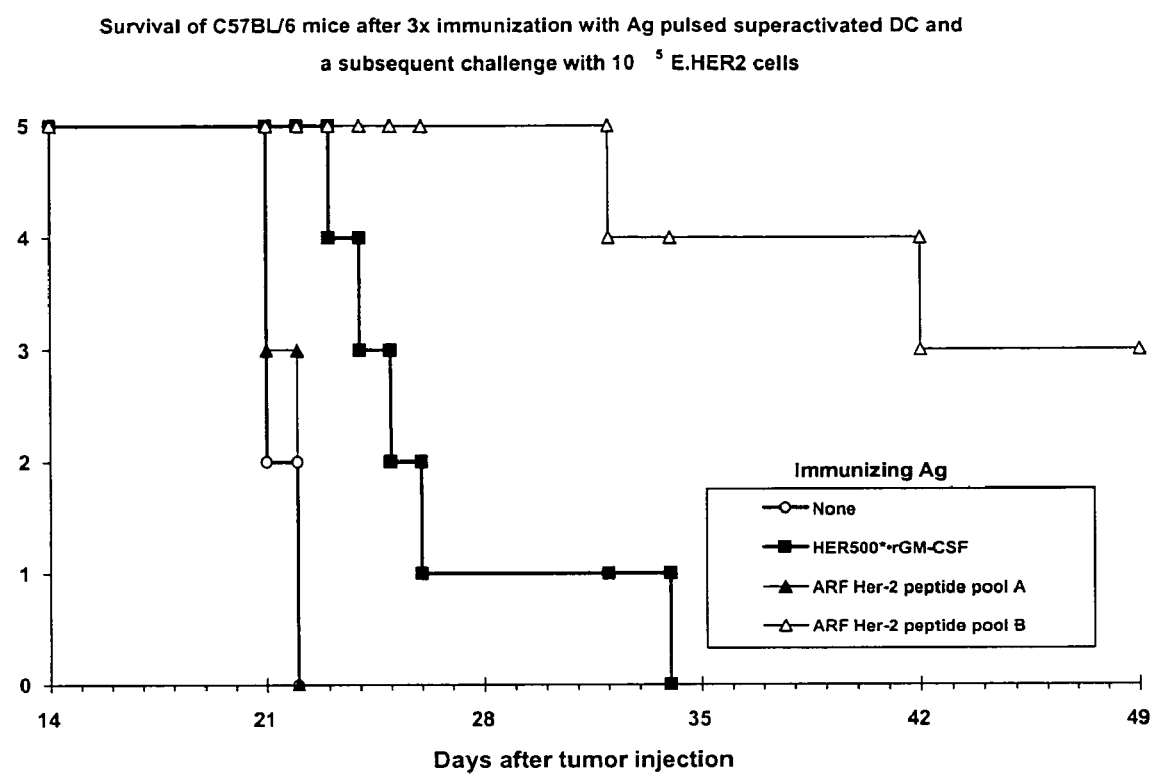
Figure 2A:
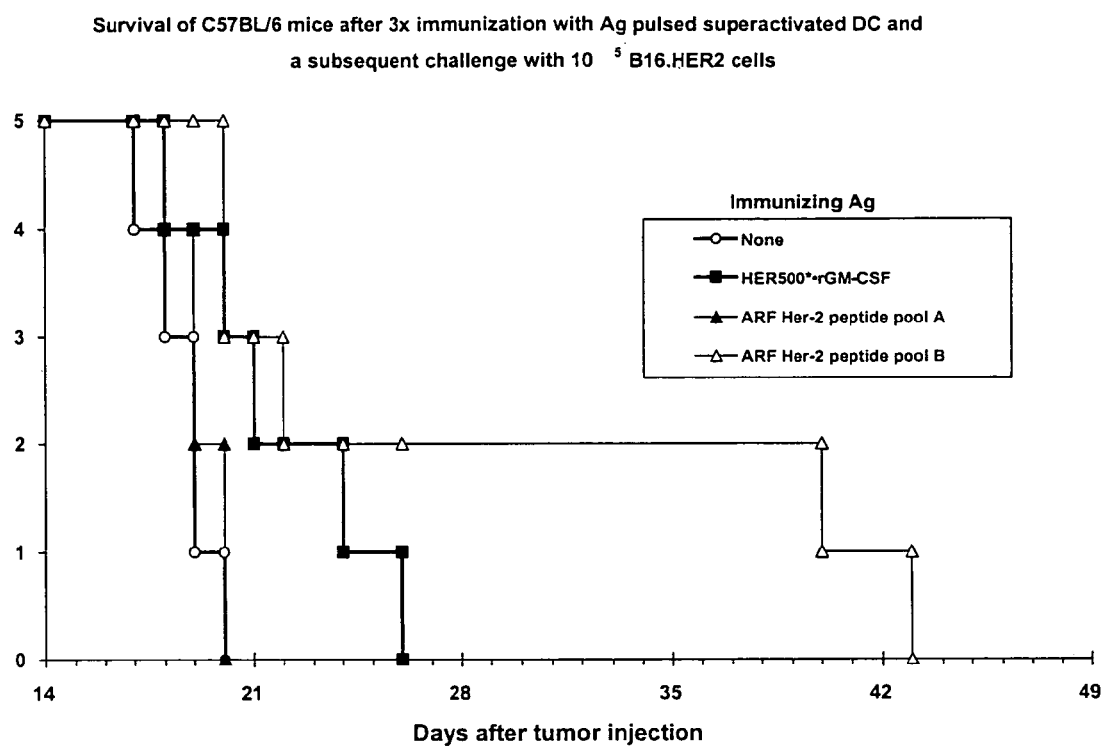
Figure 2B:
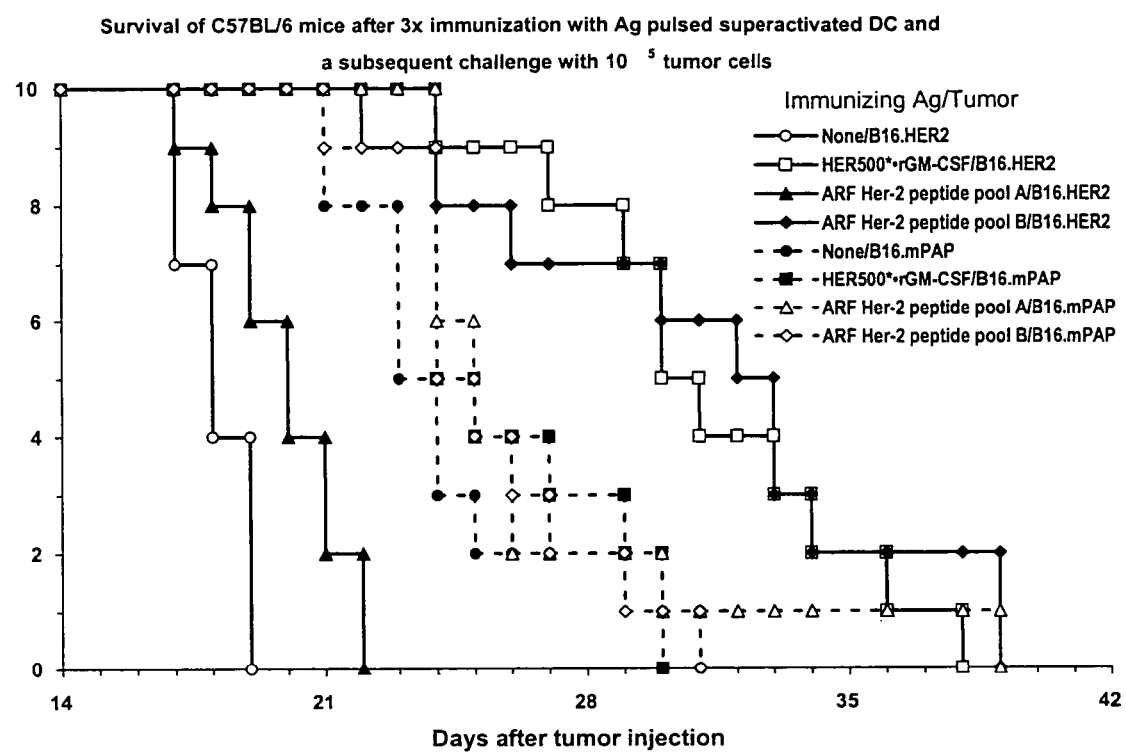

The effect of pre-immunization with HER-2-ARF polypeptide-pulsed activated DC on suppression of in vivo growth of HER-2-expressing autologous tumors was evaluated in a mouse animal model system. The results of two independent experiments using hHER-2/EL4 cells are shown in FIGS. 1A and 1B, respectively. The results of two independent experiments using hHER-2/B 16 tumor cells are shown in FIGS. 2A and 2B, respectively.

Immunization with HER-2 ARF Pool B or HER500rGM-CSF pulsed DC prevented tumor growth, whereas treatment with Pool A or HER300 had little effect. The protein antigens HER500rGM-CSF and HER300 act as positive and negative controls, respectively (FIG. 1A).

The melanoma B16 tumor model is more aggressive than the thymoma EL4 tumor line; few if any immunized mice survive tumor challenge with B16 cells. When mice were challenged with B16 cells expressing an irrelevant antigen (i.e. mouse PAP), there was no protection provided by HER-2 ARF polypeptide Pool B, HER500rGM-CSF, or HER-2 ARF polypeptide Pool A. This result indicates that the protection observed against challenge by B16 tumor line expressing hHER-2 provided by HER-2 ARF Pool B or HER500rGM-CSF (but not HER-2 ARF Pool A) was specific to expression of the HER-2 gene in the tumor cell line.

Figure 3:
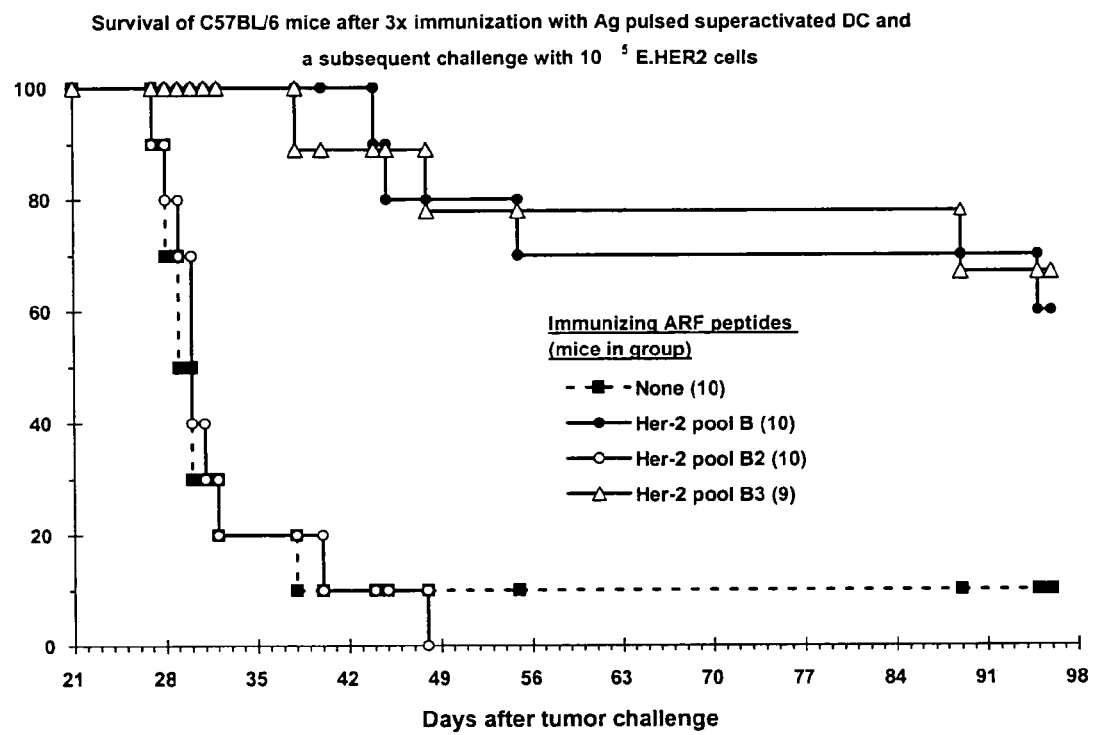

Mice immunized with Pool B were protected against tumor challenge with either hHER-2/EL4 or hHER-2/B16 tumor cells. In contrast, immunization with Pool A was ineffective in protecting the mice against tumor challenge. FIG. 3 demonstrates that when Pool B was further subdivided, Pool B3 protected against tumor challenge, and yet the structurally similar Pool B2 did not.

Thus, the results shown in FIGS. 1 and 2 indicate that Pool B was a significantly better immunogen than HER500rGM-CSF in the hHER-2/EL4 tumor model and in the hHER-2/B16 tumor model. When Pool B was further subdivided into the 6 overlapping polypeptides representing the rf1 ARF polypeptide initiating at nucleotide 2 (i.e. Pool B2) and the 25 overlapping polypeptides corresponding to the rf2 ARF polypeptide initiating at nucleotide 3 (i.e. Pool B3), only Pool B3 was protective against hHER-2/EL4 tumor challenge (FIG. 3).

EXAMPLE 30

Prevention of In Vivo Tumor Growth by Pre-Immunization with mTERT Alternative Reading Frame Antigen-Pulsed Dendritic Cells This Example discloses the protective anti-tumor efficacy of dendritic cells loaded ex vivo with mouse TERT ARF polypeptide pools.

Figure 4A:
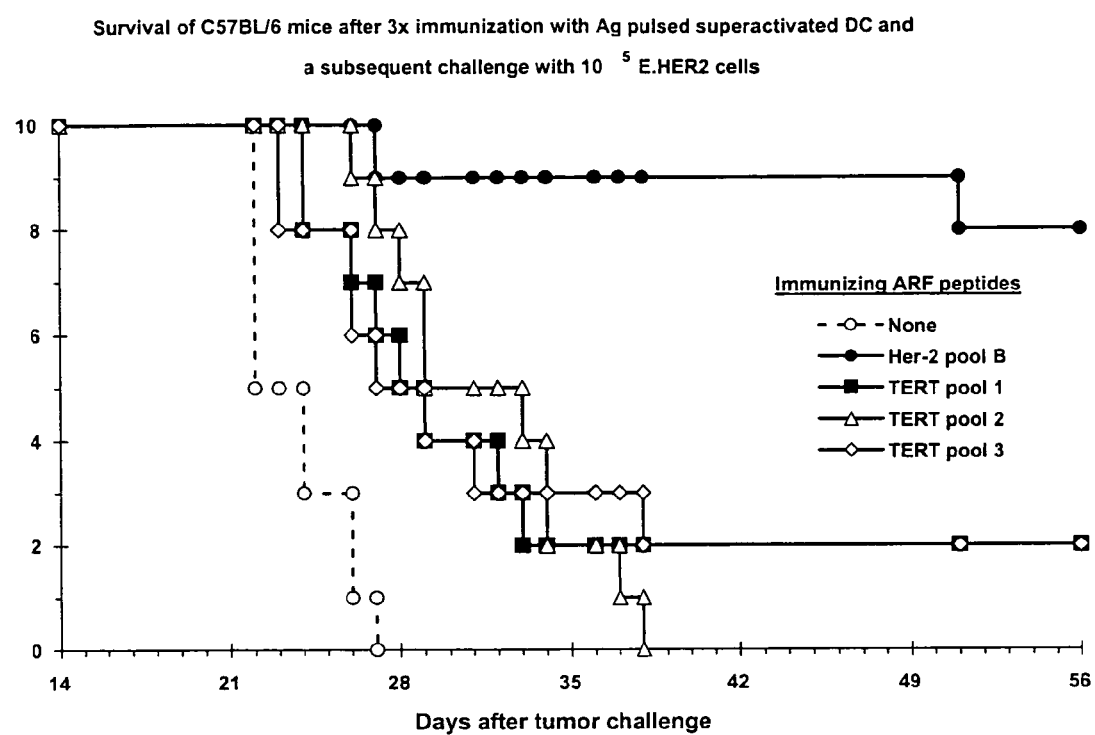
Figure 4B:
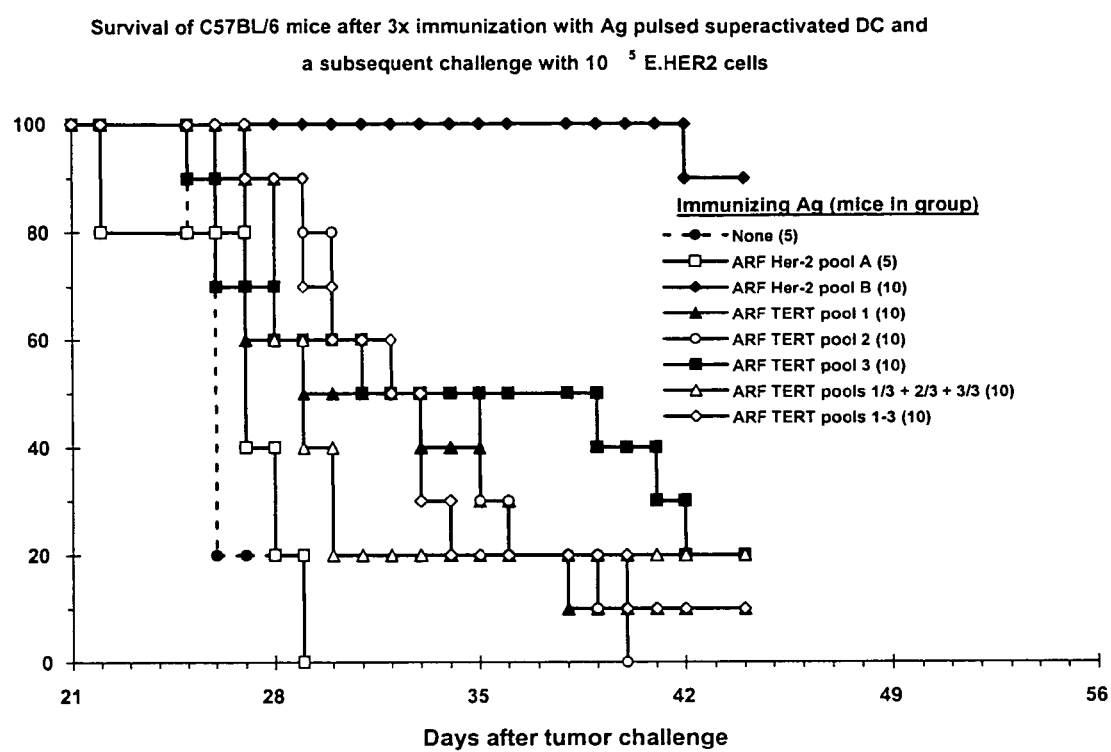
Figure 5:
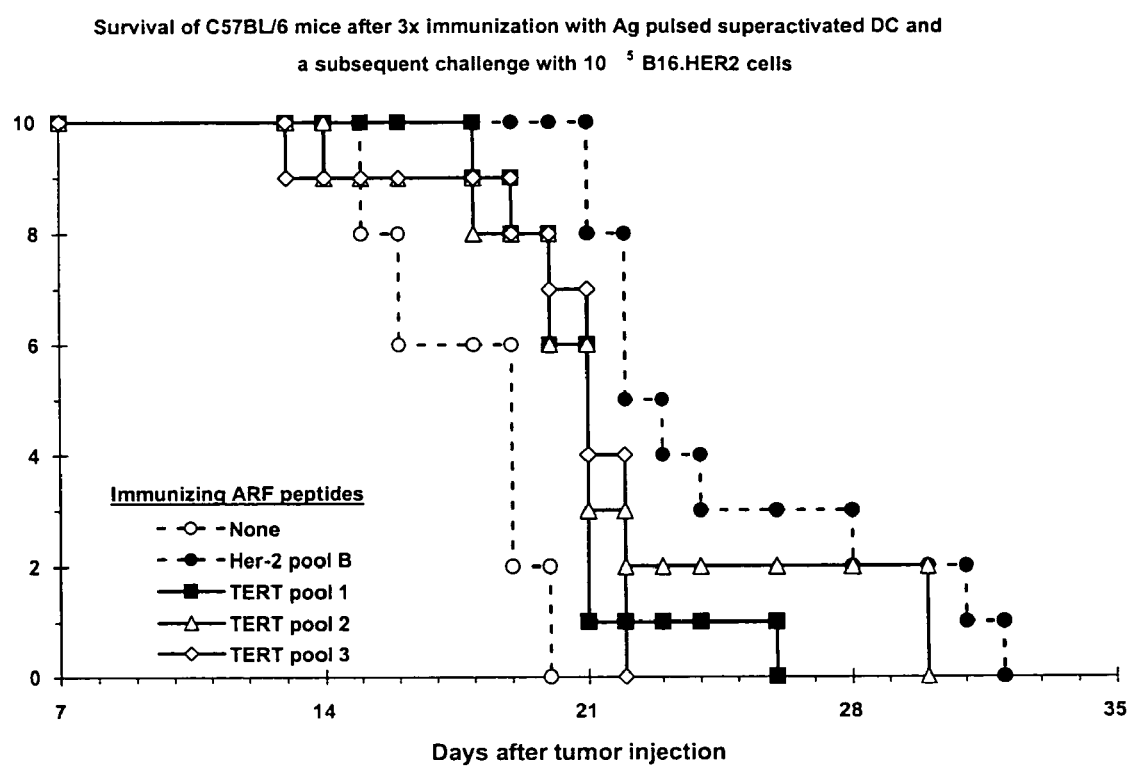
FIG. 5 is a graph depicting the survival of C57BL/6 mice pre-immunized with the indicated ARF polypeptide-pulsed dendritic cells (DC) followed by challenge with hHER-2/B16 (B16-HER2) tumor cells. The graph depicts the results of an experiment employing 10 mice per group.

Western blot and RT-PCR analyses of nuclear extracts were employed to demonstrate that tumor cell lines B16 and EL4 both express endogenous mouse TERT from genomic sequence. The data in FIGS. 4A and 4B show that immunization with mTERT ARF pools 1, 2, and 3 were approximately equally protective in mice challenged with hHER-2/EL4 tumors. hHER-2 ARF Pool B acted as a positive control while Pool A served as a negative control. Dendritic cells loaded with mTERT Pools 1, 2 and 3 combined into a single pool elicited tumor protection equivalent to the individual pools of ARF peptides. The same general pattern of tumor protection was observed when mice were challenged with the hHER-2/B16 tumor cells (FIG. 5A). DC loaded with each of the three mTERT ARF pools were equally protective against tumor challenge.

Figure 6A:
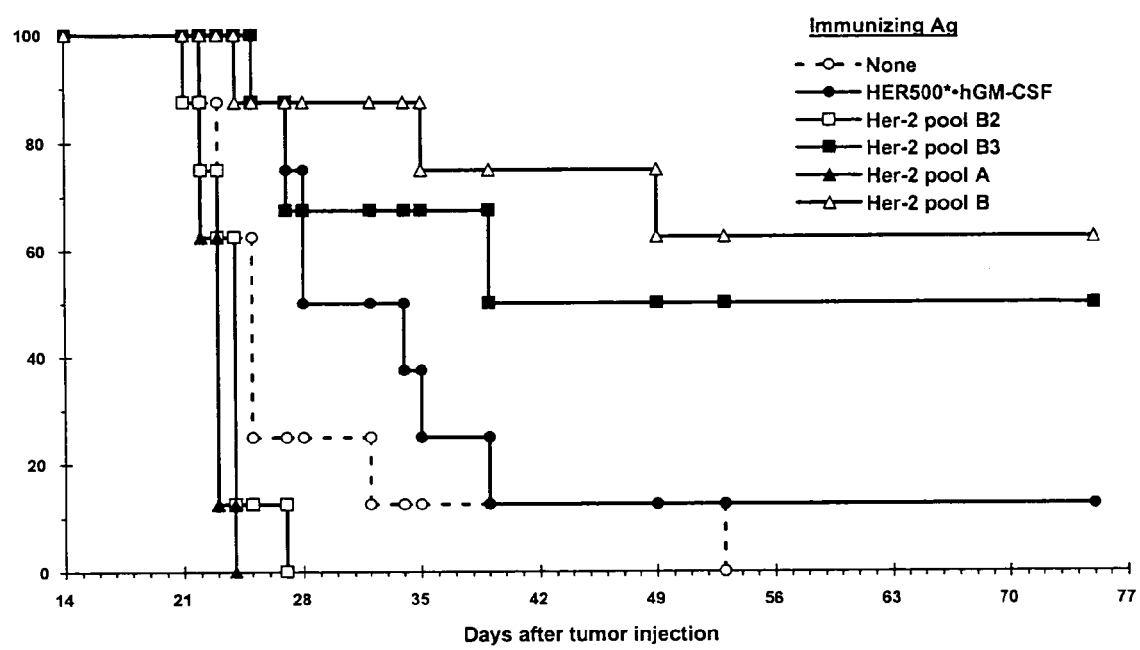
FIGS. 6A and 6B are graphs depicting the survival of mice pre-immunized with the indicated antigen followed by tumor challenge with E.HER2 (FIG. 6A) and HER2/pCR3.1 (FIG. 6B). Experiments depicted in FIGS. 6A and 6B employ 8 mice per group.
Figure 6B:
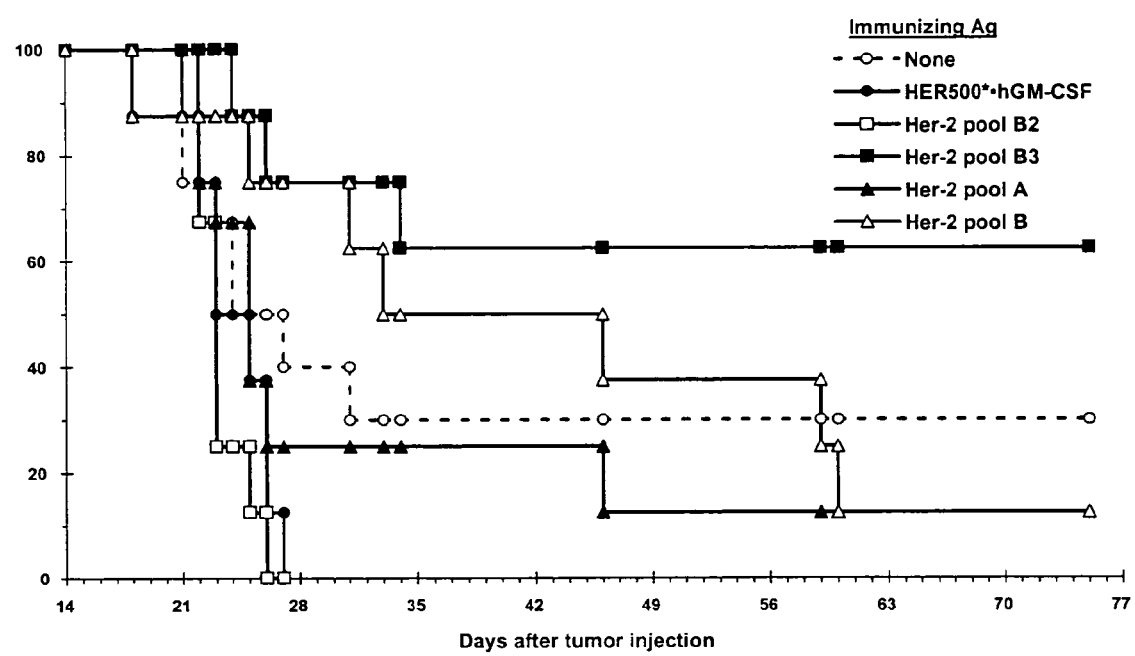

In a second pair of experiments, the survival of mice pre-immunized with E.HER2 and HER2/pCR3.1 antigen followed by tumor challenge was assessed. Results of these experiments are presented herein in FIGS. 6A and 6B, respectively.

EXAMPLE 31

Prevention of In Vivo Tumor Growth by Immunization with PAP-Derived ARF Peptides This Example discloses the in vivo efficacy of PAP-derived ARF peptides in reducing tumor growth.

As presented within Example 5, Table 8, there are nine PAP Arf sequences. The first two initiate at nucleotide positions 5 and 3, respectively (relative to rf0 initiating AUG), and the remaining seven initiate with the AUG 3' to the rf0 AUG. The corresponding 23 overlapping peptides average 15 residues in length with a moving window of four residues. See, Example 5, Table 9; SEQ ID NOs. 257-279. These peptides average 15 residues in length. A moving window of four residues was used to overlap consecutive polypeptides. Each open reading frame is named by the position of the first and the last nucleotide.

These 23 peptides were combined into a single pool and were administered in vivo to mice. The mice that were immunized with PAP-derived Arf peptides exhibited prolonged survival after the subsequent challenge with PAP-expressing tumor E.PAP. FIG. 7. The comparable level of protection was induced when PAP-derived recombinant GM-CSF fusion protein (PAP•hGM-CSF) was used as an immunogen. Similar to the HER-2$^+$ tumor model described in Example 29, the observed in vivo effects were Ag-specific, because immunizations with PAP-derived Arf peptides did not protect the mice against the PAP-tumor E.HER2.

EXAMPLE 32

Immunological Mechanism of ARF Peptide-Induced Anti-Tumor Protection

To elucidate the contribution of distinct immune system compartments to the anti-tumor protection that was observed, mice were immunized with B3 pool of HER-2-derived Arf peptides, and then depleted of either CD4$^+$ or CD8$^+$ cells. In vivo elimination of either CD4$^+$ or CD8$^+$ T cells rendered these mice susceptible to subsequent challenge with E.HER2 (FIG. 8A) while the depletion of NK1.1$^+$ cells had no such effect. These data demonstrated that both CD4$^+$ and CD8$^+$ T cells were important in achieving optimal tumor clearance.

To define the individual peptide(s) responsible for anti-tumor protection, HER-2-derived Arf pool B3 was subdivided into 5 groups, each pool containing 4-5 peptides. Only mice immunized with the sub-pool containing peptides 3e, 3f, 3g, and 3h exhibited the same degree of anti-tumor resistance as the animals immunized with the entire B3 pool. FIG. 8B. Further testing of individual peptides of interest revealed the strong protective capabilities of 3g and 3h. FIG. 8C. Since these two peptides share the same 11-mer sequence RHEAAAPCQSR (SEQ ID NO: 734), these data suggest that this epitope is efficacious in the protection of mice against challenge with a HER-2-expressing tumor.

To test the possibility that the demonstrated in vivo efficacy of the 11-mer sequence was due to the specific elimination of tumor by T lymphocytes recognizing the Arf epitope, Arf peptide-specific T cells were tested for response to the same tumor in vitro. CD8 T cell hybridoma B6-H9.B7, specific for the protective Arf peptide 3h, was isolated from mice immunized with HER-2-derived Arf pool B peptides. FIG. 8D. This hybridoma was stimulated by untransfected EL-4 tumor cells pre-pulsed with the peptide 3h as well as an E.HER2 tumor transfectant in the absence of any externally added Arf peptide. Since the HER-2 primary structure does not comprise a sequences homologous to the protective Arf 11-mer, above, it is likely that the corresponding Arf epitope was generated within E.HER2 cells.

Arf epitope-specific MHC class I-dependent $CD8^+$ T cell hybridoma B6.H9-B7 was obtained by fusing thymoma cell line BWZ.36CD8 with splenocytes of mice immunized with HER-2-derived Arf pool B3 peptides. Sanderson et al., *Int. Immunol.* 6:369-376 (1994). The T cell hybridoma assay was performed as described previously. Karttunen et al., *Proc. Natl. Acad. Sci. USA.* 88:3972-3976 (1991). Briefly, $10^5$ hybridoma cells were incubated in 0.2 ml micro-wells with designated washed Ag-pulsed APC. Stimulation of B6.H9-B7 was visualized after incubation with chlorophenol red B-galactoside (expressed in relative light units). FIG. 8E.

Although the present invention has been described in some detail by way of illustration and example for purposes of clarity of understanding, changes and modifications can be carried out without departing from the scope of the invention, which is intended to be limited only by the scope of the appended claims.

SEQUENCE LISTING (738 sequences)

SEQ ID NO: 1 - protein, 1255 aa, Homo sapiens
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIVSAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERAKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 2 - DNA, 4530 bp, Homo sapiens
aattctcgagctcgtcgaccggtcgacgagctcgagggtcgacgagctcgagggcgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcgtctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaagggccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagacgaaataaagacccaggggagaatgggtgttgtatggggaggcaagtgtggggggtccttctccacacccactttgtccatttgcaaatatattttggaaaac

SEQ ID NO: 3 - protein, 1132 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 4 - DNA, 4015 bp, Homo sapiens
gcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaa

SEQ ID NO: 5 - protein, 1122 aa, Homo sapiens
MTRAPRCPAVRSLLRSRYREVWPLATFVRRLGPEGRRLVQPGDPKIYRTLVAQCLVCMHWGSQPPPADLSFHQVSSLKELVARVVQRLCERNERNVLAFGFELLNEARGGPPMAFTSSVRSYLPNTVIETLRVSGAWMLLLSRVGDDLLVYLLAHCALYLLVPPSCAYQVCGSPLYQICATTDIWPSVSASYRPTRPVGRNFTNLRFLQQIKSSSRQEAPKPLALPSRGTKRHLSLTSTSVPSAKKARCYPVPRVEEGPHRQVLPTPSGKSWVPSPARSPEVPTAEKDLSSKGKVSDLSLSGSVCCKHKPSSTSLLSPPRQNAFQLRPFIETRHFLYSRGDGQERLNPSFLLSNLQPNLTGARRLVEIIFLGSRPRTSGPLCRTHRLSRRYWQMRPLFQQLLVNHAECQYVRLLRSHCRFRTANQQVTDALNTSPPHLMDLLRLHSSPWQVYGFLRACLCKVVSASLWGTRHNERRFFKNLKKFISLGKYGKLSLQELMWKMKVEDCHWLRSSPGKDRVPAAEHRLRERILATFLFWLMDTYVVQLLRSFFYITESTFQKNRLFFYRKSVWSKLQSIGVRQHLERVRLRELSQEEVRHHQDTWLAMPICRLRFIPKPNGLRPIVNMSYSMGTRALGRRKQAQHFTQRLKTLFSMLNYERTKHPHLMGSSVLGMNDIYRTWRAFVLRVRALDQTPRMYFVKADVTGAYDAIPQGKLVEVVANMIRHSESTYCIRQYAVVRRDSQGQVHKSFRRQVTTLSDLQPYMGQFLKHLQDSDASALRNSVVIEQSISMNESSSSLFDFFLHFLRHSVVKIGDRCYTQCQGIPQGSSLSTLLCSLCFGDMENKLFAEVQRDGLLLRFVDDFLLVTPHLDQAKTFLSTLVHGVPEYGCMINLQKTVVNFPVEPGTLGGAAPYQLPAHCLFPWCGLLLDTQTLEVFCDYSGYAQTSIKTSLTFQSVFKAGKTMRNKLLSVLRLKCHGLFLDLQVNSLQTVCINIYKIFLLQAYRFHACVIQLPFDQRVRKNLTFFLGIISSQASCCYAILKVKNPGMTLKASGSFPPEAAHWLCYQAFLLKLAAHSVIYKCLLGPLRTAQKLLCRKLPEATMTILKAAADPALSTDFQTILD

SEQ ID NO: 6 - DNA, 3426 bp, Homo sapiens
gtgggaggcccatcccggccttgagcacaatgacccgcgctcctcgttgccccgcggtgcgctctctgctgcgcagccgataccgggaggtgtggccgctggcaacctttgtgcggcgcctggggcccgagggcaggcggcttgtgcaacccggggacccgaagatctaccgcactttggttgcccaatgcctagtgtgcatgcactggggctcacagcctccacctgccgacctttccttccaccaggtgtcatccctgaaagagctggtggccagggttgtgcagagactctgcgagcgcaacgagagaaacgtgctggcttttggctttgagctgcttaacgaggccagaggcgggcctcccatggccttcactagtagcgtgcgtagctacttgcccaacactgttattgagaccctgcgtgtcagtggtgcatggatgctactgttgagccgagtgggcgacgacctgctggtctacctgctggcacactgtgctctttatcttctggtgccccccagctgtgcctaccaggtgtgtgggtctcccctgtaccaaatttgtgccaccacggatatctggccctctgtgtccgctagttacaggcccacccgacccgtgggcaggaatttcactaaccttaggttcttacaacagatcaagagcagtagtcgccaggaagcaccgaaacccctggccttgccatctcgaggtacaaagaggcatctgagtctcaccagtacaagtgtgccttcagctaagaaggccagatgctatcctgtcccgagagtggaggagggaccccacaggcaggtgctaccaaccccatcaggcaaatcatgggtgccaagtcctgctcggtcccccgaggtgcctactgcagagaaagatttgtcttctaaaggaaaggtgtctgacctgagtctctctgggtcggtgtgctgtaaacacaagcccagctccacatctctgctgtcaccaccccgccaaaatgcctttcagctcaggccatttattgagaccagacatttcctttactccaggggagatggccaagagcgtctaaacccctcattcctactcagcaacctccagcctaacttgactggggccaggagactggtggagatcatctttctgggctcaaggcctaggacatcaggaccactctgcaggacacaccgtctatcgcgtcgatactggcagatgcggcccctgttccaacagctgctggtgaaccatgcagagtgccaatatgtcagactcctcaggtcacattgcaggtttcgaacagcaaaccaacaggtgacagatgccttgaacaccagcccaccgcacctcatggatttgctccgcctgcacagcagtccctggcaggtatatggttttcttcgggcctgtctctgcaaggtggtgtctgctagtctctggggtaccaggcacaatgagcgccgcttctttaagaacttaaagaagttcatctcgttggggaaatacggcaagctatcactgcaggaactgatgtggaagatgaaagtagaggattgccactggctccgcagcagcccggggaaggaccgtgtccccgctgcagagcaccgtctgagggagaggatcctggctacgttcctgttctggctgatggacacatacgtggtacagctgcttaggtcattcttttacatcacagagagcacattccagaagaacaggctcttcttctaccgtaagagtgtgtggagcaagctgcagagcattggagtcaggcaacaccttgagagagtgcggctacgggagctgtcacaagaggaggtcaggcatcaccaggacacctggctagccatgcccatctgcagactgcgcttcatccccaagcccaacggcctgcggcccattgtgaacatgagttatagcatgggtaccagagctttgggcagaaggaagcaggcccagcatttcacccagcgtctcaagactctcttcagcatgctcaactatgagcggacaaaacatcctcaccttatggggtcttctgtactgggtatgaatgacatctacaggacctggcgggcctttgtgctgcgtgtgcgtgctctggaccagacacccaggatgtactttgttaaggcagatgtgaccggggcctatgatgccatcccccagggtaagctggtggaggttgttgccaatatgatcaggcactcggagagcacgtactgtatccgccagtatgcagtggtccggagagatagccaaggccaagtccacaagtcctttaggagacaggtcaccaccctctctgacctccagccatacatgggccagttccttaagcatctgcaggattcagatgccagtgcactgaggaactccgttgtcatcgagcagagcatctctatgaatgagagcagcagcagcctgtttgacttcttcctgcacttcctgcgtcacagtgtcgtaaagattggtgacaggtgctatacgcagtgccagggcatcccccagggctccagcctatccaccctgctctgcagtctgtgtttcggagacatggagaacaagctgtttgctgaggtgcagcgggatgggttgcttttacgttttgttgatgactttctgttggtgacgcctcacttggaccaagcaaaaaccttcctcagcaccctggtccatggcgttcctgagtatgggtgcatgataaacttgcagaagacagtggtgaacttccctgtggagcctggtaccctgggtggtgcagctccataccagctgcctgctcactgcctgtttccctggtgtggcttgctgctggacactcagactttggaggtgttctgtgactactcaggttatgcccagacctcaattaagacgagcctcaccttccagagtgtcttcaaagctgggaagaccatgcggaacaagctcctgtcggtcttgcggttgaagtgtcacggtctatttctagacttgcaggtgaacagcctccagacagtctgcatcaatatatacaagatcttcctgcttcaggcctacaggttccatgcatgtgtgattcagcttccctttgaccagcgtgttaggaagaacctcacattctttctgggcatcatctccagccaagcatcctgctgctatgctatcctgaaggtcaagaatccaggaatgacactaaaggcctctggctcctttcctcctgaagccgcacattggctctgctaccaggccttcctgctcaagctggctgctcattctgtcatctacaaatgtctcctgggacctctgaggacagcccaaaaactgctgtgccggaagctcccagaggcgacaatgaccatccttaaagctgcagctgacccagccctaagcacagactttcagaccattttggactaaccctgtctccttccgctagatgaacatg

SEQ ID NO: 7 - protein, 1104 aa, Homo sapiens
MSFRAARLSMRNRRNDTLDSTRTLYSSASRSTDLSYSESDLVNFIQANFKKRECVFFIKDSKATENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEGYFLAQYLMDDFTRDPLYILDNNHTHLLLVDNGCHGHPTVEAKLRNQLEKYISERTIQDSNYGGKIPIVCFAQGGGKETLKAINTSIKNKIPCVVVEGSGQIADVIASLVEVEDALTSSAVKEKLVRFLPRTVSRLPEEETESWIKWLKEILECSHLLTVIKMEEAGDEIVSNAISYALYKAFSTSEQDKDNWNGQLKLLLEWNQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFIAQPGVQNFLSKQWYGEISRDTKNWKIILCLFIIPLVGCGFVSFRKKPVDKHKKLLWYYVAFFTSPFVVFSWNVVFYIAFLLLFAYVLLMDFHSVPHPPELVLYSLVFVLFCDEVRQWYVNGVNYFTDLWNVMDTLGLFYFIAGIVFRLHSSNKSSLYSGRVIFCLDYIIFTLRLIHIFTVSRNLGPKIIMLQRMLIDVFFFLFLFAVWMVAFGVARQGILRQNEQRWRWIFRSVIYEPYLAMFGQVPSDVDGTTYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKLNDLKGLLKEIANKIK

SEQ ID NO: 8 - DNA, 5674 bp, Homo sapiens
aagaaaatcctgcttgacaaaaaccgtcacttaggaaaagatgtcctttcgggcagccaggctcagcatgaggaacagaaggaatgacactctggacagcacccggaccctgtactccagcgcgtctcggagcacagacttgtcttacagtgaaagcgacttggtgaattttattcaagcaaattttaagaaacgagaatgtgtcttctttatcaaagattccaaggccacggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgatgaagtacatcggggaggtggtgagagataacaccatcagcaggagttcagaggagaatattgtggccattggcatagcagcttggggcatggtctccaaccgggacaccctcatcaggaattgcgatgctgagggctattttttagcccagtaccttatggatgacttcacaagagatccactgtatatcctggacaacaaccacacacatttgctgctcgtggacaatggctgtcatggacatcccactgtcgaagcaaagctccggaatcagctagagaagtatatctctgagcgcactattcaagattccaactatggtggcaagatccccattgtgtgttttgcccaaggaggtggaaaagagactttgaaagccatcaatacctccatcaaaaataaaattccttgtgtggtggtggaaggctcgggccagatcgctgatgtgatcgctagcctggtggaggtggaggatgccctgacatcttctgccgtcaaggagaagctggtgcgctttttaccccgcacggtgtcccggctgcctgaggaggagactgagagttggatcaaatggctcaaagaaattctcgaatgttctcacctattaacagttattaaaatggaagaagctggggatgaaattgtgagcaatgccatctcctacgctctatacaaagccttcagcaccagtgagcaagacaaggataactggaatgggcagctgaagcttctgctggagtggaaccagctggacttagccaatgatgagattttcaccaatgaccgccgatgggagtctgctgaccttcaagaagtcatgtttacggctctcataaaggacagacccaagtttgtccgcctctttctggagaatggcttgaacctacggaagtttctcacccatgatgtcctcactgaactcttctccaaccacttcagcacgcttgtgtaccggaatctgcagatcgccaagaattcctataatgatgccctcctcacgtttgtctggaaactggttgcgaacttccgaagaggcttccggaaggaagacagaaatggccgggacgagatggacatagaactccacgacgtgtctcctattactcggcaccccctgcaagctctcttcatctgggccattcttcagaataagaaggaactctccaaagtcatttgggagcagaccaggggctgcactctggcagccctgggagccagcaagcttctgaagactctggccaaagtgaagaacgacatcaatgctgctggggagtccgaggagctggctaatgagtacgagacccgggctgttgagctgttcactgagtgttacagcagcgatgaagacttggcagaacagctgctggtctattcctgtgaagcttggggtggaagcaactgtctggagctggcggtggaggccacagaccagcatttcatcgcccagcctggggtccagaattttctttctaagcaatggtatggagagatttcccgagacaccaagaactggaagattatcctgtgtctgtttattatacccttggtgggctgtggctttgtatcatttaggaagaaacctgtcgacaagcacaagaagctgctttggtactatgtggcgttcttcacctcccccttcgtggtcttctcctggaatgtggtcttctacatcgccttcctcctgctgtttgcctacgtgctgctcatggatttccattcggtgccacacccccccgagctggtcctgtactcgctggtctttgtcctcttctgtgatgaagtgagacagtggtacgtaaatggggtgaattattttactgacctgtggaatgtgatggacacgctggggcttttttacttcatagcaggaattgtatttcggctccactcttctaataaaagctctttgtattctggacgagtcattttctgtctggactacattattttcactctaagattgatccacatttttactgtaagcagaaacttaggacccaagattataatgctgcagaggatgctgatcgatgtgttcttcttcctgttcctctttgcggtgtggatggtggcctttggcgtggccaggcaagggatccttaggcagaatgagcagcgctggaggtggatattccgttcggtcatctacgagccctacctggccatgttcggccaggtgcccagtgacgtggatggtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagaaaaacatggagtcttctgtctgctgtttcaaaaatgaagacaatgagactctggcatgggagggtgtcatgaaggaaaactaccttgtcaagatcaacacaaaagccaacgacacctcagaggaaatgaggcatcgatttagacaactggatacaaagcttaatgatctcaagggtcttctgaaagagattgctaataaaatcaaataaaatcaaataaaactgtatgaaactctaatggagaaaaatctaattatagcaagatcatattaaggaatgctgatgaacaattttgctatcgactactaaatgagagattttcagacccctgggtacatggtggatgattttaaatcaccctagtgtgctgagaccttgagaataaagtgtgtgattggtttcatacttgaagacggatataaaggaagaatatttcctttatgtgtttctccagaatggtgcctgtttctctctgtgtctcaatgcctgggactggaggttgatagtttaagtgtgttcttaccgcctcctttttcctttaatcttatttttgatgaacacatatataggagaacatctatcctatgaataagaacctggtcatgctttactcctgtattgttattttgttcatttccaattgattctctacttttcccttttttgtattatgtgactaattagttggcatattgttaaaagtctctcaaattaggccagattctaaaacatgctgcagcaagaggaccccgctctcttcaggaaaagtgttttcatttctcaggatgcttcttacctgtcagaggaggtgacaaggcagtctcttgctctcttggactcaccaggctcctattgaaggaaccacccccattcctaaatatgtgaaaagtcgcccaaaatgcaaccttgaaaggcactactgactttgttcttattggatactcctcttatttattatttttccattaaaaataatagctggctattatagaaaatttagaccatacagagatgtagaaagaacataaattgtccccattaccttaaggtaatcactgctaacaatttctggatggtttttcaagtctattttttttctatgtatgtctcaattctctttcaaaattttacagaatgttatcatactacatatatactttttatgtaagctttttcacttagtattttatcaaatatgtttttattatattcatagccttcttaaacattatatcaataattgcataataggcaacctctagcgattaccataattttgctcattgaaggctatctccagttgatcattgggatgagcatctttgtgcatgaatcctattgctgtatttgggaaaattttccaaggttagattccaataaatatctatttattattaaatattaaaatatcgatttattattaaaaccatttataaggctttttcataaatgtatagcaaataggaattattaacttgagcataagatatgagatacatgaacctgaactattaaaataaaatattatatttaaccctagtttaagaagaagtcaatatgcttatttaaatattatggatggtgggcagatcacttgaggtcaggagttcgagaccagcctggccaacatggcaaaaccacatctctactaaaaataaaaaaattagctgggtgtggtggtgcactcctgtaatcccagctactcagaaggctgaggtacaagaattgctggaacctgggaggcggaggttgcagtgaaccaagattgcaccactgcactccagccggggtgacagagtgagactccgactgaaaataaataaataaataaataaataaataaataaataaatattatggatggtgaagggaatggtatagaattggagagattatcttactgaacacctgtagtcccagctttctctggaagtggtggtatttgagcaggatgtgcacaaggcaattgaaatgcccataattagtttctcagctttgaatacactataaactcagtggctgaaggaggaaattttagaaggaagctactaaaagatctaatttgaaaaactacaaaagcattaactaaaaaagtttattttccttttgtctgggcagtagtgaaaataactactcacaacattcactatgtttgcaaggaattaacacaaataaaagatgcctttttacttaaacgccaagacagaaaacttgcccaatactgagaagcaacttgcattagagagggaactgttaaatgttttcaacccagttcatctggtggatgtttttgcaggttactctgagaattttgcttatgaaaaatcattatttttagtgtagttcacaataatgtattgaacatacttctaatcaaaggtgctatgtccttgtgtatggtactaaatgtgtcctgtgtacttttgcacaactgagaatcctgcggcttggtttaatgagtgtgttcatgaaataaataatggaggaattgtcaaaaaaaaaaaaaaaaaaaaaaaaaaaaaaaaaaaa

SEQ ID NO: 9 - protein, 386 aa, Homo sapiens
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQGTEDSTD

SEQ ID NO: 10 - DNA, 3061 bp, Homo sapiens
cggctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaacttatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccctagctgtcctctggagaggtttgctgagctggttggccctgtgatccctcaagactggtccacggagtgtatgaccacaaacagccatcaaggtactgaggacagtacagattagtgtgcacagagatctctgtagaaagagtagctgccctttctcagggcagatgatgctttgagaacatactttggccattaccccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataagtctgttctttaaatttctgaaatggaacagatttcaaaaaaaattcccacaatctagggtgggaacaaggaaggaaagatgtgaataggctgatggggaaaaaaccaatttacccatcagttccagccttctctcaaggagaggcaaagaaaggagatacagtggagacatctggaaagttttctccactggaaaactgctactatctgtttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatcccagcattttgggactccgaggtgggcagatcacttgagctcaggagctcaagatcagcctgggcaacatggtgaaaccttgtctctacataaaatacaaaaacttagatgggcatggtgctgtgtgcctatagtccactacttgtggggctaaggcaggaggatcacttgagccccggaggtcgaggctacagtgacccaagagtgcactactgtactccagccagggcaagagagcgagaccctgtctcaataaataaataaataaataaataaataaataaataaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttccatgtggcagatctacatgtctagagaacactgtgctctattaccattatggataaagatgagatggtttctagagatggtttctactggctgccagaatctagagcaaagccatcccccctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaaaaaaaaaa

SEQ ID NO: 11 - protein, 386 aa, Homo sapiens [sequence omitted]

SEQ ID NO: 12 - DNA, 2403 bp, Homo sapiens
gctcctaactcctggccagaaacagctctcctcaacatgagagctgcacccctcctcctggccagggcagcaagcttagcctttgcttcttgtttctgctttttttgctggctagaccgaagtgtactagccaaggagttgaagtttgtgactttggtgtttcggcatggacaccgaagtcccattgacacctttcccactgaccccataaaggaatcctcatggccacaaaggatttggccaactcacccagctggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctgggagcccatcccggtgcacacagttcctctttctgaagatcagttgctatacctgcgtttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactaccggaatgagacgcagcacgagccgtatcccctcatgctacctggatgcagccccagctgtcctctggagaggtttgctgagctggttggccctgtgatccctcaagactggtccacggagtgtatgaccacaaacagccatcaaggtactgagaacagtacagattagtgtgcacagagatctctgtagaaggagtagctgccctttctcagggcagatgatgctttgagaacgtactttggccattaccccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagacaagcctgttctttaaattgctgaaatggaacagatttcaaaaaaaacgcccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgtttttatatttctgttaaaatatatgaggctacagaactaaaaattaaaacctcttggtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagaagtgttgactctaaagttgatttaagggcaggcatggtggtttacgcctataatcccagcattttgggagtccgaggtgggcagatcacttgagctcaggaggtcaagatcagcctgggcaacatggtgaaaccttggctctacataaaatacaaaaacttagatgggcatggtggtgtgtgcctatagtccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaaaaaaaaaaa

SEQ ID NO: 13 - DNA, 2091 bp, Homo sapiens
atgagagctgcacccctcctcctggccagggcagcaagccttagccttggcttcttgtttctgctttttttctggctagaccgaagtgtactagccaaggagttggcgcgcggggccgcgtcgacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatccgctagcatcattaatttcgagaagttgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaagggccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagcggccgcccccacccgctcacccaaccctgtcacccggccctggaagcatgtagatgccatcaaagaagctctgagcctcctaaatgacatgcgtgctctggagaacgaaaagaacgaagacgtagacatcatctctaatgagttctccatccagaggccgacatgtgtgcagacccgcctgaagctatacaagcagggtctacggggcaacctcaccaaactcaatggcgccttgaccatgatagccagccactaccagacgaactgccctccaaccccggaaactgactgtgaaatagaagtcaccacctttgaggatttcataaagaaccttaaaggctttctgtttgatatcccttttgactgctggaagccggtccagaaaggcgcgccacccccgccggcgcatcaccatcaccatcac

SEQ ID NO: 14 - DNA, 1437 bp, Homo sapiens
atgagagctgcacccctcctcctggccagggcagcaagccttagccttggcttcttgtttctgctttttttctggctagaccgaagtgtactagccaaggagttggcgcgcggggccgcgtcgacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatccgctagcatcattaatttcgagaagttggccgcccccacccgctcacccaaccctgtcacccggccctggaagcatgtagatgccatcaaagaagctctgagcctcctaaatgacatgcgtgctctggagaacgaaaagaacgaagacgtagacatcatctctaatgagttctccatccagaggccgacatgtgtgcagacccgcctgaagctatacaagcagggtctacggggcaacctcaccaaactcaatggcgccttgaccatgatagccagccactaccagacgaactgccctccaaccccggaaactgactgtgaaatagaagtcaccacctttgaggatttcataaagaaccttaaaggctttctgtttgatatcccttttgactgctggaagccggtccagaaaggcgcgccacccccgccggcgcatcaccatcaccatcac

SEQ ID NO: 15 - protein, 32 aa, Artificial Sequence
  Made in a lab from synthetic material
APWSWRPCAAGGSSSPSCPPEPRAPKCAPAQT

SEQ ID NO: 16 - protein, 138 aa, Artificial Sequence
  Made in a lab from synthetic material
ARPPPLAAPRAPRPPSRVQPEPWGRSRSEHHGAGGLVPLGAPPRPLAPRSREHPSVHRHRHEAAAPCQSRDPPGHAPPPLPGLPGGAGKPGTHLPAHQCQPVLPAGYPGGAGLRAHRSQPSEAGPTAEAADCARHPAL

SEQ ID NO: 17 - protein, 23 aa, Artificial Sequence
  Made in a lab from synthetic material
MPACPSCRISRRCRATCSSLTTK

SEQ ID NO: 18 - protein, 59 aa, Artificial Sequence
  Made in a lab from synthetic material
MSSVLPAARAPSTLTAWPASTSTTVASVSCTAQPWSPTTQTRLSPCPIPRAGIHSAPAV

SEQ ID NO: 19 - protein, 27 aa, Artificial Sequence
  Made in a lab from synthetic material
MEHSGVRSAASPVPECAMVWAWSTCER

SEQ ID NO: 20 - protein, 48 aa, Artificial Sequence
  Made in a lab from synthetic material
MGTQPPTLPRSSQSSSKCLRLWKRSQVTYTSQHGRTACLTSASSRTCK

SEQ ID NO: 21 - protein, 22 aa, Artificial Sequence
  Made in a lab from synthetic material
MPSTAGAPQGVCECQALFAVPP

SEQ ID NO: 22 - protein, 18 aa, Artificial Sequence
  Made in a lab from synthetic material
MPGTVCRATLSVSPRMAQ

SEQ ID NO: 23 - protein, 33 aa, Artificial Sequence
  Made in a lab from synthetic material
MRRAHASLAPSTAPTPVWTWMTRAAPPSREPAL

SEQ ID NO: 24 - protein, 16 aa, Artificial Sequence
  Made in a lab from synthetic material
MPALPHQLHPLLCGPG

SEQ ID NO: 25 - protein, 9 aa, Artificial Sequence
  Made in a lab from synthetic material
MSPAFWASA

SEQ ID NO: 26 - protein, 14 aa, Artificial Sequence
  Made in a lab from synthetic material
MSGKTADAWAPRTC

SEQ ID NO: 27 - protein, 72 aa, Artificial Sequence
  Made in a lab from synthetic material
MCGSYTGTWPLGTCWSRVPTMSKLQTSGWLGCWTLTRQSTMQMGARCPSSGWRWSPFSAGGSPTRVMCGVMV

SEQ ID NO: 28 - protein, 29 aa, Artificial Sequence
  Made in a lab from synthetic material
MGSQPGRSLTCWKRGSGCPSPPSAPLMST

SEQ ID NO: 29 - protein, 10 aa, Artificial Sequence
  Made in a lab from synthetic material
MSAKIPGVGV

SEQ ID NO: 30 - protein, 68 aa, Artificial Sequence
  Made in a lab from synthetic material
MRTWAQPVPWTAPSTAHCWRTMTWGTWWMLRSIWYPSRASSVQTLPRALGAWSTTGTAAHLPGVAVGT

SEQ ID NO: 31 - protein, 47 aa, Artificial Sequence
  Made in a lab from synthetic material
MYLMVTWEWGQPRGCKASPHMTPALYSGTVRTPQYPCPLRLMATLPP

SEQ ID NO: 32 - protein, 52 aa, Artificial Sequence
  Made in a lab from synthetic material
MFGPSPLRPERALCLLPDLLVPLWKGPRLSPQGRMGSSKTFLPLGVPWRTPS

SEQ ID NO: 33 - protein, 23 aa, Artificial Sequence
  Made in a lab from synthetic material
MPACPSCRISRRCRATCSSLTTK

SEQ ID NO: 34 - protein, 23 aa, Artificial Sequence
  Made in a lab from synthetic material
MSSVLPAARAPSTLTAWPASTST

SEQ ID NO: 35 - protein, 23 aa, Artificial Sequence
  Made in a lab from synthetic material
TAWPASTSTTVASVSCTAQPWSP

SEQ ID NO: 36 - protein, 22 aa, Artificial Sequence
  Made in a lab from synthetic material
VSCTAQPWSPTTQTRLSPCPIP

SEQ ID NO: 37 - protein, 20 aa, Artificial Sequence
  Made in a lab from synthetic material
QTRLSPCPIPRAGIHSAPAV

SEQ ID NO: 38 - protein, 27 aa, Artificial Sequence
  Made in a lab from synthetic material
MEHSGVRSAASPVPECAMVWAWSTCER

SEQ ID NO: 39 - protein, 23 aa, Artificial Sequence
  Made in a lab from synthetic material
MGTQPPTLPRSSQSSSKCLRLWK

SEQ ID NO: 40 - protein, 23 aa, Artificial Sequence
  Made in a lab from synthetic material
SSSKCLRLWKRSQVTYTSQHGRT

SEQ ID NO: 41 - protein, 22 aa, Artificial Sequence
  Made in a lab from synthetic material
VTYTSQHGRTACLTSASSRTCK

SEQ ID NO: 42 - protein, 22 aa, Artificial Sequence
  Made in a lab from synthetic material
MPSTAGAPQGVCECQALFAVPP

SEQ ID NO: 43 - protein, 18 aa, Artificial Sequence
  Made in a lab from synthetic material
MPGTVCRATLSVSPRMAQ

SEQ ID NO: 44 - protein, 22 aa, Artificial Sequence
  Made in a lab from synthetic material
MRRAHASLAPSTAPTPVWTWMT

SEQ ID NO: 45 - protein, 21 aa, Artificial Sequence
  Made in a lab from synthetic material
APTPVWTWMTRAAPPSREPAL

SEQ ID NO: 46 - protein, 16 aa, Artificial Sequence
  Made in a lab from synthetic material
MPALPHQLHPLLCGPG

SEQ ID NO: 47 - protein, 14 aa, Artificial Sequence
  Made in a lab from synthetic material
MSGKTADAWAPRTC

SEQ ID NO: 48 - protein, 23 aa, Artificial Sequence
  Made in a lab from synthetic material
MCGSYTGTWPLGTCWSRVPTMSK

SEQ ID NO: 49 - protein, 23 aa, Artificial Sequence
  Made in a lab from synthetic material
CWSRVPTMSKLQTSGWLGCWTLT

SEQ ID NO: 50 - protein, 23 aa, Artificial Sequence
  Made in a lab from synthetic material
SGWLGCWTLTRQSTMQMGARCPS

SEQ ID NO: 51 - protein, 23 aa, Artificial Sequence
  Made in a lab from synthetic material
TMQMGARCPSSGWRWSPFSAGGS

SEQ ID NO: 52 - protein, 20 aa, Artificial Sequence
  Made in a lab from synthetic material
RWSPFSAGGSPTRVMCGVMV

SEQ ID NO: 53 - protein, 29 aa, Artificial Sequence
  Made in a lab from synthetic material
MGSQPGRSLTCWKRGSGCPSPPSAPLMST

SEQ ID NO: 54 - protein, 10 aa, Artificial Sequence
  Made in a lab from synthetic material
MSAKIPGVGV

SEQ ID NO: 55 - protein, 24 aa, Artificial Sequence
  Made in a lab from synthetic material
MRTWAQPVWTAPSTAHCWRTMTWG

SEQ ID NO: 56 - protein, 24 aa, Artificial Sequence
  Made in a lab from synthetic material
AHCWRTMTWGTWWMLRSIWYPSRA

SEQ ID NO: 57 - protein, 24 aa, Artificial Sequence
  Made in a lab from synthetic material
LRSIWYPSRASSVQTLPRALGAWS

SEQ ID NO: 58 - protein, 25 aa, Artificial Sequence
  Made in a lab from synthetic material
TLPRALGAWSTTGTAAHLPGVAVGT

SEQ ID NO: 59 - protein, 24 aa, Artificial Sequence
  Made in a lab from synthetic material
MYLMVTWEWGQPRGCKASPHMTPA

SEQ ID NO: 60 - protein, 24 aa, Artificial Sequence
  Made in a lab from synthetic material
CKASPHMTPALYSGTVRTPQYPCP

SEQ ID NO: 61 - protein, 19 aa, Artificial Sequence
  Made in a lab from synthetic material
TVRTPQYPCPLRLMATLPP

SEQ ID NO: 62 - protein, 25 aa, Artificial Sequence
  Made in a lab from synthetic material
MFGPSPLRPERALCLLPDLLVPLWK

SEQ ID NO: 63 - protein, 25 aa, Artificial Sequence
  Made in a lab from synthetic material
LPDLLVPLWKGPRLSPQGRMGSSKT

SEQ ID NO: 64 - protein, 23 aa, Artificial Sequence
  Made in a lab from synthetic material
PQGRMGSSKTFLPLGVPWRTPST

SEQ ID NO: 65 - protein, 15 aa, Artificial Sequence
  Made in a lab from synthetic material
WSWRPCAAGGSSSPS

SEQ ID NO: 66 - protein, 15 aa, Artificial Sequence
  Made in a lab from synthetic material
PCAAGGSSSPSCPPE

SEQ ID NO: 67 - protein, 15 aa, Artificial Sequence
  Made in a lab from synthetic material
GGSSSPSCPPEPRAP

SEQ ID NO: 68 - protein, 15 aa, Artificial Sequence
  Made in a lab from synthetic material
SPSCPPEPRAPKCAP

SEQ ID NO: 69 - protein, 14 aa, Artificial Sequence
  Made in a lab from synthetic material
PPEPRAPKCAPAQT

SEQ ID NO: 70 - protein, 10 aa, Artificial Sequence
  Made in a lab from synthetic material
RAPKCAPAQT

SEQ ID NO: 71 - protein, 15 aa, Artificial Sequence
  Made in a lab from synthetic material
GAGGLVPLGAPPRPL

SEQ ID NO: 72 - protein, 15 aa, Artificial Sequence
  Made in a lab from synthetic material
LVPLGAPPRPLAPRS

SEQ ID NO: 73 - protein, 15 aa, Artificial Sequence
  Made in a lab from synthetic material
GAPPRPLAPRSREHP

SEQ ID NO: 74 - protein, 15 aa, Artificial Sequence
  Made in a lab from synthetic material
RPLAPRSREHPSVHR

SEQ ID NO: 75 - protein, 15 aa, Artificial Sequence
  Made in a lab from synthetic material
PRSREHPSVHRHRHE

SEQ ID NO: 76 - protein, 15 aa, Artificial Sequence
  Made in a lab from synthetic material
EHPSVHRHRHEAAAP

SEQ ID NO: 77 - protein, 15 aa, Artificial Sequence
  Made in a lab from synthetic material
VHRHRHEAAAPCQSR

SEQ ID NO: 78 - protein, 15 aa, Artificial Sequence
  Made in a lab from synthetic material
RHEAAAPCQSRDPPG

SEQ ID NO: 79 - protein, 15 aa, Artificial Sequence
  Made in a lab from synthetic material
AAPCQSRDPPGHAPP

SEQ ID NO: 80 - protein, 15 aa, Artificial Sequence
  Made in a lab from synthetic material
QSRDPPGHAPPPLPG

SEQ ID NO: 81 - protein, 15 aa, Artificial Sequence
  Made in a lab from synthetic material
PPGHAPPPLPGLPGG

SEQ ID NO: 82 - protein, 15 aa, Artificial Sequence
  Made in a lab from synthetic material
APPPLPGLPGGAGKP

SEQ ID NO: 83 - protein, 15 aa, Artificial Sequence
  Made in a lab from synthetic material
LPGLPGGAGKPGTHL

SEQ ID NO: 84 - protein, 15 aa, Artificial Sequence
  Made in a lab from synthetic material
PGGAGKPGTHLPAHQ

SEQ ID NO: 85 - protein, 15 aa, Artificial Sequence
  Made in a lab from synthetic material
GKPGTHLPAHQCQPV

SEQ ID NO: 86 - protein, 15 aa, Artificial Sequence
  Made in a lab from synthetic material
THLPAHQCQPVLPAG

SEQ ID NO: 87 - protein, 15 aa, Artificial Sequence
  Made in a lab from synthetic material
AHQCQPVLPAGYPGG

SEQ ID NO: 88 - protein, 15 aa, Artificial Sequence
  Made in a lab from synthetic material
QPVLPAGYPGGAGLR

SEQ ID NO: 89 - protein, 15 aa, Artificial Sequence
  Made in a lab from synthetic material
PAGYPGGAGLRAHRS

SEQ ID NO: 90 - protein, 15 aa, Artificial Sequence
  Made in a lab from synthetic material
PGGAGLRAHRSQPSE

SEQ ID NO: 91 - protein, 15 aa, Artificial Sequence
  Made in a lab from synthetic material
GLRAHRSQPSEAGPT

SEQ ID NO: 92 - protein, 15 aa, Artificial Sequence
  Made in a lab from synthetic material
HRSQPSEAGPTAEAA

SEQ ID NO: 93 - protein, 15 aa, Artificial Sequence
  Made in a lab from synthetic material
PSEAGPTAEAADCAR

SEQ ID NO: 94 - protein, 15 aa, Artificial Sequence
  Made in a lab from synthetic material
GPTAEAADCARHPAL

SEQ ID NO: 95 - protein, 11 aa, Artificial Sequence
  Made in a lab from synthetic material
EAADCARHPAL

SEQ ID NO: 96 - protein, 53 aa, Artificial Sequence
  Made in a lab from synthetic material
PALLVAPRCALCCAADTGRCGRWQPLCGAWGPRAGGLCNPGTRRSTALWLPNA

SEQ ID NO: 97 - protein, 101 aa, Artificial Sequence
  Made in a lab from synthetic material
NDPRSSLPRGALSAAQPIPGGVAAGNLCAAPGARGQAACATRGPEDLPHFGCPMPSVHALGLTASTCRPFLPPGVIPERAGGQGCAETLRAQREKRAGFWL

SEQ ID NO: 98 - protein, 48 aa, Artificial Sequence
  Made in a lab from synthetic material
MPSVHALGLTASTCRPFLPPGVIPERAGGQGCAETLRAQREKRAGFWL

SEQ ID NO: 99 - protein, 54 aa, Artificial Sequence
  Made in a lab from synthetic material
MDATVEPSGRRPAGLPAGTLCSLSSGAPQLCLPGVWVSPVPNLCHHGYLALCVR

SEQ ID NO: 100 - protein, 43 aa, Artificial Sequence
  Made in a lab from synthetic material
MLSCPESGGGTPQAGATNPIRQIMGAKSCSVPRGAYCRERFVF

SEQ ID NO: 101 - protein, 24 aa, Artificial Sequence
  Made in a lab from synthetic material
MPFSSGHLLRPDISFTPGEMAKSV

SEQ ID NO: 102 - protein, 22 aa, Artificial Sequence
  Made in a lab from synthetic material
MQSANMSDSSGHIAGFEQQTNR

SEQ ID NO: 103 - protein, 29 aa, Artificial Sequence
  Made in a lab from synthetic material
MVFFGPVSARWCLLVSGVPGTMSAASLRT

SEQ ID NO: 104 - protein, 16 aa, Artificial Sequence
  Made in a lab from synthetic material
MSGQNILTLWGLLYWV

SEQ ID NO: 105 - protein, 29 aa, Artificial Sequence
  Made in a lab from synthetic material
MTSTGPGGPLCCVCVLWTRHPGCTLLRQM

SEQ ID NO: 106 - protein, 15 aa, Artificial Sequence
  Made in a lab from synthetic material
MMPSPRVSWWRLLPI

SEQ ID NO: 107 - protein, 44 aa, Artificial Sequence
  Made in a lab from synthetic material
MQWSGEIAKAKSTSPLGDRSPPSLTSSHTWASSLSICRIQMPVH

SEQ ID NO: 108 - protein, 19 aa, Artificial Sequence
  Made in a lab from synthetic material
MRAAAACLTSSCTSCVTVS

SEQ ID NO: 109 - protein, 13 aa, Artificial Sequence
  Made in a lab from synthetic material
MGCFYVLLMTFCW

SEQ ID NO: 110 - protein, 31 aa, Artificial Sequence
  Made in a lab from synthetic material
MPRPQLRRASPSRVSSKLGRPCGTSSCRSCG

SEQ ID NO: 111 - protein, 25 aa, Artificial Sequence
  Made in a lab from synthetic material
MSPGTSEDSPKTAVPEAPRGDNDHP

SEQ ID NO: 112 - protein, 15 aa, Artificial Sequence
  Made in a lab from synthetic material
DPRSSLPRGALSAAQ

SEQ ID NO: 113 - protein, 15 aa, Artificial Sequence
  Made in a lab from synthetic material
SLPRGALSAAQPIPG

SEQ ID NO: 114 - protein, 15 aa, Artificial Sequence
  Made in a lab from synthetic material
GALSAAQPIPGGVAA

SEQ ID NO: 115 - protein, 15 aa, Artificial Sequence
  Made in a lab from synthetic material
AAQPIPGGVAAGNLC

SEQ ID NO: 116 - protein, 15 aa, Artificial Sequence
  Made in a lab from synthetic material
IPGGVAAGNLCAAPG

SEQ ID NO: 117 - protein, 15 aa, Artificial Sequence
  Made in a lab from synthetic material
VAAGNLCAAPGARGQ

SEQ ID NO: 118 - protein, 15 aa, Artificial Sequence
  Made in a lab from synthetic material
NLCAAPGARGQAACA

SEQ ID NO: 119 - protein, 15 aa, Artificial Sequence
  Made in a lab from synthetic material
APGARGQAACATRGP

SEQ ID NO: 120 - protein, 15 aa, Artificial Sequence
  Made in a lab from synthetic material
RGQAACATRGPEDLP

SEQ ID NO: 121 - protein, 15 aa, Artificial Sequence
  Made in a lab from synthetic material
ACATRGPEDLPHFGC

SEQ ID NO: 122 - protein, 15 aa, Artificial Sequence
  Made in a lab from synthetic material
RGPEDLPHFGCPMPS

SEQ ID NO: 123 - protein, 15 aa, Artificial Sequence
  Made in a lab from synthetic material
DLPHFGCPMPSVHAL

SEQ ID NO: 124 - protein, 15 aa, Artificial Sequence
  Made in a lab from synthetic material
FGCPMPSVHALGLTA

SEQ ID NO: 125 - protein, 15 aa, Artificial Sequence
  Made in a lab from synthetic material
MPSVHALGLTASTCR

SEQ ID NO: 126 - protein, 15 aa, Artificial Sequence
  Made in a lab from synthetic material
HALGLTASTCRPFLP

SEQ ID NO: 127 - protein, 15 aa, Artificial Sequence
  Made in a lab from synthetic material
LTASTCRPFLPPGVI

SEQ ID NO: 128 - protein, 15 aa, Artificial Sequence
  Made in a lab from synthetic material
TCRPFLPPGVIPERA

SEQ ID NO: 129 - protein, 15 aa, Artificial Sequence
  Made in a lab from synthetic material
FLPPGVIPERAGGQG

SEQ ID NO: 130 - protein, 15 aa, Artificial Sequence
  Made in a lab from synthetic material
GVIPERAGGQGCAET

SEQ ID NO: 131 - protein, 15 aa, Artificial Sequence
  Made in a lab from synthetic material
ERAGGQGCAETLRAQ

SEQ ID NO: 132 - protein, 15 aa, Artificial Sequence
  Made in a lab from synthetic material
GQGCAETLRAQREKR

SEQ ID NO: 133 - protein, 16 aa, Artificial Sequence
  Made in a lab from synthetic material
AETLRAQREKRAGFWL

SEQ ID NO: 134 - protein, 15 aa, Artificial Sequence
  Made in a lab from synthetic material
PALLVAPRCALCCAA

SEQ ID NO: 135 - protein, 15 aa, Artificial Sequence
  Made in a lab from synthetic material
VAPRCALCCAADTGR

SEQ ID NO: 136 - protein, 15 aa, Artificial Sequence
  Made in a lab from synthetic material
CALCCAADTGRCGRW

SEQ ID NO: 137 - protein, 15 aa, Artificial Sequence
  Made in a lab from synthetic material
CAADTGRCGRWQPLC

SEQ ID NO: 138 - protein, 15 aa, Artificial Sequence
  Made in a lab from synthetic material
TGRCGRWQPLCGAWG

SEQ ID NO: 139 - protein, 15 aa, Artificial Sequence
  Made in a lab from synthetic material
GRWQPLCGAWGPRAG

SEQ ID NO: 140 - protein, 15 aa, Artificial Sequence
  Made in a lab from synthetic material
PLCGAWGPRAGGLCN

SEQ ID NO: 141 - protein, 15 aa, Artificial Sequence
  Made in a lab from synthetic material
AWGPRAGGLCNPGTR

SEQ ID NO: 142 - protein, 15 aa, Artificial Sequence
  Made in a lab from synthetic material
RAGGLCNPGTRRSTA

SEQ ID NO: 143 - protein, 17 aa, Artificial Sequence
  Made in a lab from synthetic material
LCNPGTRRSTALWLPNA

SEQ ID NO: 144 - protein, 15 aa, Artificial Sequence
  Made in a lab from synthetic material
MDATVEPSGRRPAGL

SEQ ID NO: 145 - protein, 15 aa, Artificial Sequence
  Made in a lab from synthetic material
VEPSGRRPAGLPAGT

SEQ ID NO: 146 - protein, 15 aa, Artificial Sequence
  Made in a lab from synthetic material
GRRPAGLPAGTLCSL

SEQ ID NO: 147 - protein, 15 aa, Artificial Sequence
  Made in a lab from synthetic material
AGLPAGTLCSLSSGA

SEQ ID NO: 148 - protein, 15 aa, Artificial Sequence
  Made in a lab from synthetic material
AGTLCSLSSGAPQLC

SEQ ID NO: 149 - protein, 15 aa, Artificial Sequence
  Made in a lab from synthetic material
CSLSSGAPQLCLPGV

SEQ ID NO: 150 - protein, 15 aa, Artificial Sequence
  Made in a lab from synthetic material
SGAPQLCLPGVWVSP

SEQ ID NO: 151 - protein, 15 aa, Artificial Sequence
  Made in a lab from synthetic material
QLCLPGVWVSPVPNL

SEQ ID NO: 152 - protein, 15 aa, Artificial Sequence
  Made in a lab from synthetic material
PGVWVSPVPNLCHHG

SEQ ID NO: 153 - protein, 18 aa, Artificial Sequence
  Made in a lab from synthetic material
VSPVPNLCHHGYLALCVR

SEQ ID NO: 154 - protein, 15 aa, Artificial Sequence
  Made in a lab from synthetic material
MLSCPESGGGTPQAG

SEQ ID NO: 155 - protein, 15 aa, Artificial Sequence
  Made in a lab from synthetic material
PESGGGTPQAGATNP

SEQ ID NO: 156 - protein, 15 aa, Artificial Sequence
  Made in a lab from synthetic material
GGTPQAGATNPIRQI

SEQ ID NO: 157 - protein, 15 aa, Artificial Sequence
  Made in a lab from synthetic material
QAGATNPIRQIMGAK

SEQ ID NO: 158 - protein, 15 aa, Artificial Sequence
  Made in a lab from synthetic material
TNPIRQIMGAKSCSV

SEQ ID NO: 159 - protein, 15 aa, Artificial Sequence
  Made in a lab from synthetic material
RQIMGAKSCSVPRGA

SEQ ID NO: 160 - protein, 15 aa, Artificial Sequence
  Made in a lab from synthetic material
GAKSCSVPRGAYCRE

SEQ ID NO: 161 - protein, 15 aa, Artificial Sequence
  Made in a lab from synthetic material
CSVPRGAYCRERFVF

SEQ ID NO: 162 - protein, 15 aa, Artificial Sequence
  Made in a lab from synthetic material
MPFSSGHLLRPDISF

SEQ ID NO: 163 - protein, 15 aa, Artificial Sequence
  Made in a lab from synthetic material
SGHLLRPDISFTPGE

SEQ ID NO: 164 - protein, 16 aa, Artificial Sequence
  Made in a lab from synthetic material
LRPDISFTPGEMAKSV

SEQ ID NO: 165 - protein, 15 aa, Artificial Sequence
  Made in a lab from synthetic material
MQSANMSDSSGHIAG

SEQ ID NO: 166 - protein, 18 aa, Artificial Sequence
  Made in a lab from synthetic material
NMSDSSGHIAGFEQQTNR

SEQ ID NO: 167 - protein, 15 aa, Artificial Sequence
  Made in a lab from synthetic material
MVFFGPVSARWCLLV

SEQ ID NO: 168 - protein, 15 aa, Artificial Sequence
  Made in a lab from synthetic material
GPVSARWCLLVSGVP

SEQ ID NO: 169 - protein, 15 aa, Artificial Sequence
  Made in a lab from synthetic material
ARWCLLVSGVPGTMS

SEQ ID NO: 170 - protein, 17 aa, Artificial Sequence
  Made in a lab from synthetic material
LLVSGVPGTMSAASLRT

SEQ ID NO: 171 - protein, 16 aa, Artificial Sequence
  Made in a lab from synthetic material
MSGQNILTLWGLLYWV

SEQ ID NO: 172 - protein, 15 aa, Artificial Sequence
  Made in a lab from synthetic material
MTSTGPGGPLCCVCV

SEQ ID NO: 173 - protein, 15 aa, Artificial Sequence
  Made in a lab from synthetic material
GPGGPLCCVCVLWTR

SEQ ID NO: 174 - protein, 15 aa, Artificial Sequence
  Made in a lab from synthetic material
PLCCVCVLWTRHPGC

SEQ ID NO: 175 - protein, 17 aa, Artificial Sequence
  Made in a lab from synthetic material
VCVLWTRHPGCTLLRQM

SEQ ID NO: 176 - protein, 15 aa, Artificial Sequence
  Made in a lab from synthetic material
MMPSPRVSWWRLLPI

SEQ ID NO: 177 - protein, 15 aa, Artificial Sequence
  Made in a lab from synthetic material
MQWSGEIAKAKSTSP

SEQ ID NO: 178 - protein, 15 aa, Artificial Sequence
  Made in a lab from synthetic material
GEIAKAKSTSPLGDR

SEQ ID NO: 179 - protein, 15 aa, Artificial Sequence
  Made in a lab from synthetic material
KAKSTSPLGDRSPPS

SEQ ID NO: 180 - protein, 15 aa, Artificial Sequence
  Made in a lab from synthetic material
TSPLGDRSPPSLTSS

SEQ ID NO: 181 - protein, 15 aa, Artificial Sequence
  Made in a lab from synthetic material
GDRSPPSLTSSHTWA

SEQ ID NO: 182 - protein, 15 aa, Artificial Sequence
  Made in a lab from synthetic material
PPSLTSSHTWASSLS

SEQ ID NO: 183 - protein, 15 aa, Artificial Sequence
  Made in a lab from synthetic material
TSSHTWASSLSICRI

SEQ ID NO: 184 - protein, 16 aa, Artificial Sequence
  Made in a lab from synthetic material
TWASSLSICRIQMPVH

SEQ ID NO: 185 - protein, 19 aa, Artificial Sequence
  Made in a lab from synthetic material
MRAAAACLTSSCTSCVTVS

SEQ ID NO: 186 - protein, 13 aa, Artificial Sequence
  Made in a lab from synthetic material
MGCFYVLLMTFCW

SEQ ID NO: 187 - protein, 15 aa, Artificial Sequence
  Made in a lab from synthetic material
MPRPQLRRASPSRVS

SEQ ID NO: 188 - protein, 15 aa, Artificial Sequence
  Made in a lab from synthetic material
QLRRASPSRVSSKLG

SEQ ID NO: 189 - protein, 15 aa, Artificial Sequence
  Made in a lab from synthetic material
ASPSRVSSKLGRPCG

SEQ ID NO: 190 - protein, 15 aa, Artificial Sequence
  Made in a lab from synthetic material
RVSSKLGRPCGTSSC

SEQ ID NO: 191 - protein, 15 aa, Artificial Sequence
  Made in a lab from synthetic material
KLGRPCGTSSCRSCG

SEQ ID NO: 192 - protein, 15 aa, Artificial Sequence
  Made in a lab from synthetic material
MSPGTSEDSPKTAVP

SEQ ID NO: 193 - protein, 15 aa, Artificial Sequence
  Made in a lab from synthetic material
TSEDSPKTAVPEAPR

SEQ ID NO: 194 - protein, 17 aa, Artificial Sequence
  Made in a lab from synthetic material
SPKTAVPEAPRGDNDHP

SEQ ID NO: 195 - protein, 77 aa, Artificial Sequence
  Made in a lab from synthetic material
RCRALPAAEPCAPCCAATTARCCRWPRSCGAWGPRAGGWCSAGTRRLSARWWPSAWCACPGTHGRPPPPPPSARCPA

SEQ ID NO: 196 - protein, 190 aa, Artificial Sequence
  Made in a lab from synthetic material
DAARSPLPSRALPAAQPLPRGAAAGHVRAAPGAPGLAAGAARGPGGFPRAGGPVPGVRALGRTAAPRRPLLPPGVLPEGAGGPSAAEAVRARREERAGLRLRAAGRGPRGPPRGLHHQRAQLPAQHGDRRTAGERGVGAAAAPRGRRRAGSPAGTLRALCAGGSQLRLPGVRAAAVPARRCHSGPAPATR

SEQ ID NO: 197 - protein, 31 aa, Artificial Sequence
  Made in a lab from synthetic material
MSRRPRFKRTGSFSTGRVSGASCKALESDST

SEQ ID NO: 198 - protein, 21 aa, Artificial Sequence
  Made in a lab from synthetic material
MPWSRRPPMGTSARPSRATSL

SEQ ID NO: 199 - protein, 10 aa, Artificial Sequence
  Made in a lab from synthetic material
MPSSSSRAPP

SEQ ID NO: 200 - protein, 74 aa, Artificial Sequence
  Made in a lab from synthetic material
MRPAVASSTSSYASCATTPCASGASPTSSARGSRRAPSSPRCSAACATATWRTSCLRGFGGTGCSCVWWMISCW

SEQ ID NO: 201 - protein, 31 aa, Artificial Sequence
  Made in a lab from synthetic material
MPGPPSEPVSPSTAASRLGGTCVANSLGSCG

SEQ ID NO: 202 - protein, 23 aa, Artificial Sequence
  Made in a lab from synthetic material
MCAAAPISSASLEEPHIFPARHL

SEQ ID NO: 203 - protein, 10 aa, Artificial Sequence
  Made in a lab from synthetic material
RCPFGQPGSA

SEQ ID NO: 204 - protein, 15 aa, Artificial Sequence
  Made in a lab from synthetic material
DVLSGSQAQHEEQKE

SEQ ID NO: 205 - protein, 27 aa, Artificial Sequence
  Made in a lab from synthetic material
MTLWTAPGPCTPARLGAQTCLTVKATW

SEQ ID NO: 206 - protein, 33 aa, Artificial Sequence
  Made in a lab from synthetic material
MCLLYQRFQGHGECVQVWLCPEPAHGRHPDQPK

SEQ ID NO: 207 - protein, 67 aa, Artificial Sequence
  Made in a lab from synthetic material
MCASVAMPRASTWKAPRSTKVRNGTTRNTPRNFLPTPLGIFSLRHWGRKGSIYVCPATRTRKSFTSC

SEQ ID NO: 208 - protein, 20 aa, Artificial Sequence
  Made in a lab from synthetic material
MELQETHQGISYRRLWGYSV

SEQ ID NO: 209 - protein, 38 aa, Artificial Sequence
  Made in a lab from synthetic material
MTSQEIHCISWTTTTHICCSWTMAVMDIPLSKQSSGIS

SEQ ID NO: 210 - protein, 17 aa, Artificial Sequence
  Made in a lab from synthetic material
MVARSPLCVLPKEVEKR

SEQ ID NO: 211 - protein, 15 aa, Artificial Sequence
  Made in a lab from synthetic material
MAQRNSRMFSPINSY

SEQ ID NO: 212 - protein, 24 aa, Artificial Sequence
  Made in a lab from synthetic material
MPSPTLYTKPSAPVSKTRITGMGS

SEQ ID NO: 213 - protein, 24 aa, Artificial Sequence
  Made in a lab from synthetic material
MMRFSPMTADGSLLTFKKSCLRLS

SEQ ID NO: 214 - protein, 58 aa, Artificial Sequence
  Made in a lab from synthetic material
MMSSLNSSPTTSARLCTGICRSPRIPIMMPSSRLSGNWLRTSEEASGRKTEMAGTRWT

SEQ ID NO: 215 - protein, 174 aa, Artificial Sequence
  Made in a lab from synthetic material
MLLGSPRSWLMSTRPGLLSCSLSVTAAMKTWQNSCWSIPVKLGVEATVWSWRWRPQTSISSPSLGSRIFFLSNGMERFPETPRTGRLSCVCLLYPWWAVALYHLGRNLSTSTRSCFGTMWRSSPPPSWSSPGMWSSTSPSSCCLPTCCSWISIRCHTPPSWSCTRWSLSSSVMK

SEQ ID NO: 216 - protein, 31 aa, Artificial Sequence
  Made in a lab from synthetic material
MVWRDFPRHQELEDYPVSVYYTLGGLWLCII

SEQ ID NO: 217 - protein, 159 aa, Artificial Sequence
  Made in a lab from synthetic material
MCSSSCSSLRCGWWPLAWPGKGSLGRMSSAGGGYSVRSSTSPTWPCSARCPVTWMVPRMTLPTAPSLGMSPSHCVWSWMSTTCPGSPSGSPSPWCASTCYPPTSCWSTCWSPCLATRWAPSRRTMTRSGSSRGTSWCRSTAAASISPSPSSSSLTSTWW

SEQ ID NO: 218 - protein, 12 aa, Artificial Sequence
  Made in a lab from synthetic material
MKTMRLWHGRVS

SEQ ID NO: 219 - protein, 28 aa, Artificial Sequence
  Made in a lab from synthetic material
MGGCHEGKLPCQDQHKSQRHLRGNEASI

SEQ ID NO: 220 - protein, 10 aa, Artificial Sequence
  Made in a lab from synthetic material
WRPFGQPGSA

SEQ ID NO: 221 - protein, 15 aa, Artificial Sequence
  Made in a lab from synthetic material
GVLSGSRAQHEEQKE

SEQ ID NO: 222 - protein, 15 aa, Artificial Sequence
  Made in a lab from synthetic material
MTLWTAPGPCTPARL

SEQ ID NO: 223 - protein, 15 aa, Artificial Sequence
  Made in a lab from synthetic material
TAPGPCTPARLGAQT

SEQ ID NO: 224 - protein, 15 aa, Artificial Sequence
  Made in a lab from synthetic material
PCTPARLGAQTCLTV

SEQ ID NO: 225 - protein, 15 aa, Artificial Sequence
  Made in a lab from synthetic material
ARLGAQTCLTVKATW

SEQ ID NO: 226 - protein, 15 aa, Artificial Sequence
  Made in a lab from synthetic material
MCLLYQRFQGHGECV

SEQ ID NO: 227 - protein, 15 aa, Artificial Sequence
  Made in a lab from synthetic material
YQRFQGHGECVQVWL

SEQ ID NO: 228 - protein, 15 aa, Artificial Sequence
  Made in a lab from synthetic material
QGHGECVQVWLCPEP

SEQ ID NO: 229 - protein, 15 aa, Artificial Sequence
  Made in a lab from synthetic material
ECVQVWLCPEPAHGR

SEQ ID NO: 230 - protein, 15 aa, Artificial Sequence
  Made in a lab from synthetic material
VWLCPEPAHGRHPDQ

SEQ ID NO: 231 - protein, 13 aa, Artificial Sequence
  Made in a lab from synthetic material
PEPAHGRHPDQPK

SEQ ID NO: 232 - protein, 15 aa, Artificial Sequence
  Made in a lab from synthetic material
MCASVAMPRASTWKA

SEQ ID NO: 233 - protein, 15 aa, Artificial Sequence
  Made in a lab from synthetic material
VAMPRASTWKAPRST

SEQ ID NO: 234 - protein, 15 aa, Artificial Sequence
  Made in a lab from synthetic material
RASTWKAPRSTKVRN

SEQ ID NO: 235 - protein, 15 aa, Artificial Sequence
  Made in a lab from synthetic material
WKAPRSTKVRNGTTR

SEQ ID NO: 236 - protein, 15 aa, Artificial Sequence
  Made in a lab from synthetic material
RSTKVRNGTTRNTPR

SEQ ID NO: 237 - protein, 15 aa, Artificial Sequence
  Made in a lab from synthetic material
VRNGTTRNTPRNFLP

SEQ ID NO: 238 - protein, 15 aa, Artificial Sequence
  Made in a lab from synthetic material
TTRNTPRNFLPTPLG

SEQ ID NO: 239 - protein, 15 aa, Artificial Sequence
  Made in a lab from synthetic material
TPRNFLPTPLGIFSL

SEQ ID NO: 240 - protein, 15 aa, Artificial Sequence
  Made in a lab from synthetic material
FLPTPLGIFSLRHWG

SEQ ID NO: 241 - protein, 15 aa, Artificial Sequence
  Made in a lab from synthetic material
PLGIFSLRHWGRKGS

SEQ ID NO: 242 - protein, 15 aa, Artificial Sequence
  Made in a lab from synthetic material
FSLRHWGRKGSIYVC

SEQ ID NO: 243 - protein, 15 aa, Artificial Sequence
  Made in a lab from synthetic material
HWGRKGSIYVCPATR

SEQ ID NO: 244 - protein, 15 aa, Artificial Sequence
  Made in a lab from synthetic material
KGSIYVCPATRTRKS

SEQ ID NO: 245 - protein, 15 aa, Artificial Sequence
  Made in a lab from synthetic material
YVCPATRTRKSFTSC

SEQ ID NO: 246 - protein, 15 aa, Artificial Sequence
  Made in a lab from synthetic material
MELQETHQGISYRRL

SEQ ID NO: 247 - protein, 16 aa, Artificial Sequence
  Made in a lab from synthetic material
ETHQGISYRRLWGYSV

SEQ ID NO: 248 - protein, 24 aa, Artificial Sequence
  Made in a lab from synthetic material
ELHPSSWPGQQALALASCFCFFSG

SEQ ID NO: 249 - protein, 14 aa, Artificial Sequence
  Made in a lab from synthetic material
HESCTPPPGQGSKP

SEQ ID NO: 250 - protein, 14 aa, Artificial Sequence
  Made in a lab from synthetic material
METEVPLTPFPLTP

SEQ ID NO: 251 - protein, 17 aa, Artificial Sequence
  Made in a lab from synthetic material
MATRIWPTHPAGHGAAL

SEQ ID NO: 252 - protein, 19 aa, Artificial Sequence
  Made in a lab from synthetic material
MSPINMNRFIFEAQTLTGL

SEQ ID NO: 253 - protein, 34 aa, Artificial Sequence
  Made in a lab from synthetic material
MARTFLEFGVKSTTLYIVRVFTISLYPPGPLRTP

SEQ ID NO: 254 - protein, 24 aa, Artificial Sequence
  Made in a lab from synthetic material
MEFTSRKRNLGSKGVSWSMKSSIT

SEQ ID NO: 255 - protein, 14 aa, Artificial Sequence
  Made in a lab from synthetic material
MFTTDSFLPMLLAT

SEQ ID NO: 256 - protein, 30 aa, Artificial Sequence
  Made in a lab from synthetic material
MRRSTSRIPSCYLAAALAVLWRGLLSWLAL

SEQ ID NO: 257 - protein, 13 aa, Artificial Sequence
  Made in a lab from synthetic material
ESCTPPPGQGSKP

SEQ ID NO: 258 - protein, 15 aa, Artificial Sequence
  Made in a lab from synthetic material
ELHPSSWPGQQALAL

SEQ ID NO: 259 - protein, 15 aa, Artificial Sequence
  Made in a lab from synthetic material
SSWPGQQALALASCF

SEQ ID NO: 260 - protein, 16 aa, Artificial Sequence
  Made in a lab from synthetic material
GQQALALASCFCFFSG

SEQ ID NO: 261 - protein, 14 aa, Artificial Sequence
  Made in a lab from synthetic material
METEVPLTPFPLTP

SEQ ID NO: 262 - protein, 17 aa, Artificial Sequence
  Made in a lab from synthetic material
MATRIWPTHPAGHGAAL

SEQ ID NO: 263 - protein, 15 aa, Artificial Sequence
  Made in a lab from synthetic material
MSPINMNRFIFEAQT

SEQ ID NO: 264 - protein, 15 aa, Artificial Sequence
  Made in a lab from synthetic material
NMNRFIFEAQTLTGL

SEQ ID NO: 265 - protein, 15 aa, Artificial Sequence
  Made in a lab from synthetic material
MARTFLEFGVKSTTL

SEQ ID NO: 266 - protein, 15 aa, Artificial Sequence
  Made in a lab from synthetic material
FLEFGVKSTTLYIVR

SEQ ID NO: 267 - protein, 15 aa, Artificial Sequence
  Made in a lab from synthetic material
GVKSTTLYIVRVFTI

SEQ ID NO: 268 - protein, 15 aa, Artificial Sequence
  Made in a lab from synthetic material
TTLYIVRVFTISLYP

SEQ ID NO: 269 - protein, 15 aa, Artificial Sequence
  Made in a lab from synthetic material
IVRVFTISLYPPGPL

SEQ ID NO: 270 - protein, 14 aa, Artificial Sequence
  Made in a lab from synthetic material
FTISLYPPGPLRTP

SEQ ID NO: 271 - protein, 15 aa, Artificial Sequence
  Made in a lab from synthetic material
MEFTSRKRNLGSKGV

SEQ ID NO: 272 - protein, 15 aa, Artificial Sequence
  Made in a lab from synthetic material
SRKRNLGSKGVSWSM

SEQ ID NO: 273 - protein, 16 aa, Artificial Sequence
  Made in a lab from synthetic material
NLGSKGVSWSMKSSIT

SEQ ID NO: 274 - protein, 14 aa, Artificial Sequence
  Made in a lab from synthetic material
MFTTDSFLPMLLAT

SEQ ID NO: 275 - protein, 15 aa, Artificial Sequence
  Made in a lab from synthetic material
MRRSTSRIPSCYLAA

SEQ ID NO: 276 - protein, 15 aa, Artificial Sequence
  Made in a lab from synthetic material
TSRIPSCYLAAALAV

SEQ ID NO: 277 - protein, 15 aa, Artificial Sequence
  Made in a lab from synthetic material
PSCYLAAALAVLWRG

SEQ ID NO: 278 - protein, 15 aa, Artificial Sequence
  Made in a lab from synthetic material
LAAALAVLWRGLLSW

SEQ ID NO: 279 - protein, 14 aa, Artificial Sequence
  Made in a lab from synthetic material
LAVLWRGLLSWLAL

SEQ ID NO: 280 - protein, 12 aa, Artificial Sequence
  Made in a lab from synthetic material
ELHPSSWPGQQA

SEQ ID NO: 281 - protein, 50 aa, Artificial Sequence
  Made in a lab from synthetic material
HESCTPPPGQGSKLSLCFLFLLFLLARPKCTSQGVEVCDFGVSAWTPKSH

SEQ ID NO: 282 - protein, 14 aa, Artificial Sequence [sequence omitted]

SEQ ID NO: 283 - protein, 17 aa, Artificial Sequence
  Made in a lab from synthetic material
MATKDLANSPSWHGAAL

SEQ ID NO: 284 - protein, 19 aa, Artificial Sequence
  Made in a lab from synthetic material
MSPINMNRFIFEAQTLTGL

SEQ ID NO: 285 - protein, 34 aa, Artificial Sequence; identical to SEQ ID NO: 253
  Made in a lab from synthetic material

SEQ ID NO: 286 - protein, 24 aa, Artificial Sequence
  Made in a lab from synthetic material
MEFTSRKRNLGSKGVSWSMKSSIT

SEQ ID NO: 287 - protein, 14 aa, Artificial Sequence
  Made in a lab from synthetic material
MFTTDSFLPMLLAT

SEQ ID NO: 288 - protein, 30 aa, Artificial Sequence
  Made in a lab from synthetic material
MRRSTSRIPSCYLDAAPAVLWRGLLSWLAL

SEQ ID NO: 289 - protein, 11 aa, Artificial Sequence
  Made in a lab from synthetic material
MQPQLSSGEVC

SEQ ID NO: 290 - DNA, 21 bp, Artificial Sequence
  Made in a lab from synthetic material
tacggtaaactgcccacttgg

SEQ ID NO: 291 - DNA, 22 bp, Artificial Sequence
  Made in a lab from synthetic material
aaatgtcgtaacaactccgccc

SEQ ID NO: 292 - DNA, 29 bp, Artificial Sequence
  Made in a lab from synthetic material
cttgcagccagcaaactcctggatattgg

SEQ ID NO: 293 - DNA, 28 bp, Artificial Sequence
  Made in a lab from synthetic material
gcacagggcttgctgcacttctcacacc

SEQ ID NO: 294 - protein, 459 aa, Homo sapiens
MAPLCPSPWLPLLIPAPAPGLTVQLLLSLLLLMPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 295 - DNA, 1552 bp, Homo sapiens
gcccgtacacaccgtgtgctgggacaccccacagtcagccgcatggctcccctgtgccccagcccctggctccctctgttgatcccggcccctgctccaggcctcactgtgcaactgctgctgtcactgctgcttctgatgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataat

SEQ ID NO: 296 - protein, 12 aa, Homo sapiens
WLPCAPAPGSLC

SEQ ID NO: 297 - protein, 56 aa, Homo sapiens
GSPVPQPLAPSVDPGPCSRPHCATAAVTAASDACPSPEVAPDAGGFPLGRRLFWGR

SEQ ID NO: 298 - protein, 51 aa, Homo sapiens
MTHWARRICPVKRIHPERRIHPERRIYLERRIYLERRIYLKLSLNQKKRAP

SEQ ID NO: 299 - protein, 76 aa, Homo sapiens
MPTGTKKGMTRVIGAMEATRPGPGCPQPARAASSPRWISAPSSPPSARPCAPWNSWASSSRRSQNCACATMATVCN

SEQ ID NO: 300 - protein, 42 aa, Homo sapiens
MSSCCLAWKKSLRKAQRLRSQDWTYLHSCPLTSAATSNMRGL

SEQ ID NO: 301 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 302 - DNA, 3036 bp, Homo sapiens
cgaccagcagaccagacagtcacagcagccttgacaaaacgttcctggaactcaagcacttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccatgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtatgacagaatacatttgaaaacattggttatattaccaagactttgactagaatgtcgtat

SEQ ID NO: 303 - protein, 37 aa, Homo sapiens
LLHRGGQSRQQRPWSLPRPLPTDGASPGRGSCSQPHF

SEQ ID NO: 304 - protein, 50 aa, Homo sapiens
FSTEEDRADSRDHGVSLGPSPQMVHPLAEAPAHSLTSNLLEPAHHCQAHY

SEQ ID NO: 305 - protein, 28 aa, Homo sapiens
MVHPLAEAPAHSLTSNLLEPAHHCQAHY

SEQ ID NO: 306 - protein, 36 aa, Homo sapiens
MSQRGRRCFYLSTICPSIFLATAGTKVKEWMATVKL

SEQ ID NO: 307 - protein, 10 aa, Homo sapiens
MTQDSTPYTS

SEQ ID NO: 308 - protein, 49 aa, Homo sapiens
MKKQLASSGYTRSCPSPPSPATTPNPWRTRMLWPSPVNLRLRTQPTCGG

SEQ ID NO: 309 - protein, 26 aa, Homo sapiens
MATGPSLYSMSQEMTQQATNVKPRTQ

SEQ ID NO: 310 - protein, 13 aa, Homo sapiens
MSSMARMPPPFPL

SEQ ID NO: 311 - protein, 31 aa, Homo sapiens
MQPLTHLHSTLGLSMGLSSNPPKSSLSPTSL

SEQ ID NO: 312 - protein, 22 aa, Homo sapiens
MQSHPNPSSPATTPTPWRMRML

SEQ ID NO: 313 - protein, 15 aa, Homo sapiens
MTTGPSLYSVSQGMM

SEQ ID NO: 314 - protein, 21 aa, Homo sapiens
MSSMAQTTPPFPPHTPITVQG

SEQ ID NO: 315 - protein, 12 aa, Homo sapiens
MQPLTHLHSILG

SEQ ID NO: 316 - protein, 84 aa, Homo sapiens
MGTSSNTHKSSLSPTSLRRTADSIPARPITQPVATAGLQSRQSQSLRSCPSPPSPATTPNPWRTRMLWPSPVNLRLRTQPTCGG

SEQ ID NO: 317 - protein, 40 aa, Homo sapiens
MVRASQSVPGCSCPMATGPSLYSMSQEMTQEPMYVESRTQ

SEQ ID NO: 318 - protein, 12 aa, Homo sapiens
MWNPELSECKPQ

SEQ ID NO: 319 - protein, 80 aa, Homo sapiens
MSSMGRTPPSFPPQTRLTFRERTSTSPATRPLTHPRSILGVSMGYRSNTHKFSLSPKSRQIITGPMPVLSLTWLLAAIIP

SEQ ID NO: 320 - protein, 415 aa, Homo sapiens
MWLPCAPAPGSLCSRPLLQASLCNCCCHCCFCLSIPRGCPGCRRIPPWEEALLGKMTHWARRICPVKRIHPERRIHPERRIYLERRIYLERRIYLKLSLNQKKRAPRIYLLLRLLEILKNPRIMPTGTKKGMTRVIGAMEATRPGPGCPQPARAASSPRWISAPSSPPSARPCAPWNSWASSSRRSQNCACATMATVCNRWLWVPGGSTGLCSCICTGGLQVVRARSTLWKATVSLPRSTWFTSAPPLPELTRPWGAREAWPCWPPFWRRARKKTVPMSSCCLAWKKSLRKAQRLRSQDWTYLHSCPLTSAATSNMRGLLHRPVPRVSSGLCLTRQVLSSSTPSLTPCGDLVTLGYSLRPPSLLEWTAVLGLLSQSSIPAWLLVTSPWFLASFLLSPASRSLCREGSTEGEPKGV

SEQ ID NO: 321 - DNA, 1248 bp, Homo sapiens
atgtggctcccctgtgccccagcccctggctccctctgttcccggcccctgctccaggcctcactgtgcaactgctgctgtcactgctgcttctgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctcccaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaacagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctcctacaccgccctgtgcccagggtgtcatctggactgtgtttaaccagacaggtgctaagcagctccacaccctctctgacaccctgtggggacctggtgactctcggctacagcttgaggcctccttccctgctggagtggacagcagtcctcgggctgctgagccagtccagcattcctgcctggctgctggtgacatccccctggtttttggcctcctttttgctgtcaccagcgtcgcgttccttgtgcagagaaggcagcacagaaggggaaccaaagggggtgtga

SEQ ID NO: 322 - protein, 404 aa, Homo sapiens
MGSPVPQPLAPSVDPGPCSRPHCATAAVTAASDACPSPEVAPDAGGFPLGRRLFWGRPTGRGGSAQRGFTQRGGSTRRGGSTWRGGSTWRGGSTIRRRGLPEVRGSTYCGSWRSSRTPEPESLALWRRPALAPGVPSLRGPLPVPGGYPPPARRLLPGPAPPGTPGLPAPAAPRTAPAQQWPQCATDPASWARDGSGSRAGVPGSAAASALGGCRSSGLGAHCGRPPFPCRDPRGSPQHRLCQSRGLGAPGRPGRVGRLSGGGPGRKQCLAVAVSLGRNRGRLRDSGPRTGHICTPALGVSDYTALCPGCHLDCVLSATAELPSDAAFEWASDGLLPCWSGQQSSGCASPAEFLPGCWHPSPGFWPPFCCHQRRVPCADEKAAQKGNQRGCELPPSRGSRDWSL

SEQ ID NO: 323 - DNA, 1215 bp, Homo sapiens
atgggctcccctgtgccccagcccctggctccctctgttgatcccggcccctgctccaggcctcactgtgcaactgctgctgtcactgctgcttctgatgcctgtccatccccagaggttgccccggatgcaggaggattcccccttgggaggaggctcttctggggaagacccactgggcgaggaggatctgcccagagaggattcacccagagaggaggatccacccggagaggaggatctacctggagaggaggatctacctggagaggaggatctaccatcagaagaagagggctccctgaagttagaggatctacctactgtggctcctggagatcctcaagaaccccagaaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagtcgaggccttggggcgcccgggaggcctggccgtgttggccgcctttctggaggagggcccggaagaaaacagtgcctagcagttgctgtctcgcttggaagaaatcgcggaaggctcagagactcaggtcccaggactggacatatctgcactcctgccctcggggtctctgactacaccgccctgtgcccagggtgtcatctggactgtgttctctcggctacagctgaacttccgagcgacgcagcctttgaatgggcgagtgatggcctccttccctgctggagtggacagcagtcctcgggctgcgccagtccagctgaattcctgcctggctgctggcatcctagccctggtttttggcctcctttttgctgtcaccagcgtcgcgttccttgtgcagatgagaaggcagcacagaaggggaaccaaagggggtgtgagctaccgcccagcagaggtagccgagactggagcctatga

SEQ ID NO: 324 - protein, 657 aa, Homo sapiens [sequence omitted]

SEQ ID NO: 325 - DNA, 1974 bp, Homo sapiens
atgtggagtctccctcggcccctccccacagatggtgcatcccctggcagaggctcctgctcacagcctcacttcccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattagaactcaacaagctaccccagggcccgcatacagtggtcgagagatccagaacatcatccagaatgacacaggattctacaccctacacgtcaagtcagatcttgatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggacaatcagagcctcccggtcagtcccaggctgcagctgtccaatggcaacaggaccctcactctattcaatgtcacaagaaatgacacagcaagctacaaatgtgaaacccagaacccaggtgccaggcgcagtgattcagtcatccatgtcctctatggcccggatgcccccaccatttcccctcacacatcttacagatcaggggaaaatcacctctcctgccatgcagcctctaacccacctgcacagtactcttggtttgtcaatgggactttccagcaatccacccaagagctctttatccccaacatcactgataatagtggatcctatacgtgccaagcccataactcagacactggcctcaataggaccacagtcacgacgatcacagtctatgcagagccacccaaacccttcatcaccagcaacaactccaaccccgtggaggatgaggatgctgcctgtgaacctgagattcagaacacaacctacctgtggtgggataatcagagcctcccggtcagtcccaggctgcagctgtccaatgacaacaggaccctcactctactcagtgtcacaaggaatgatggaccctatgagtgtggaatccagaacgaatgtgttgaccacagcgacccagtcatccatgtcctctatggcccagacgaccccaccatttccccctcatacacctattaccgtccaggggacctcagcctctcctgccatgcagcctctaacccacctgcacagtattcttggcttgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggatggtcagagcctcccagtcagtcccaggctgcagctgtccaatggcaacaggaccctcactctattcaatgtcacaagaaatgacgcaagagcctatgtatgtggaatccagaactcaggtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatcaagagcatcacagtctctgcatctggaacttctcctggtctctcagctggggccactgtcggcatcatga

SEQ ID NO: 326 - protein, 620 aa, Homo sapiens [sequence omitted]

SEQ ID NO: 327 - DNA, 1863 bp, Homo sapiens
atgggagtctccctcggcccctccccacagatggtgcatcccctggcagaggctcctgctcacagcctcacttctaaccttctggaacccgcccaccactgccaagctcactatatccacgccgttcaatgtcgcagaggggaaggaggtgcttctacttgtccacaatctgccccagcatctttttggctacagctggtacaaaggaagagtggatggcaaccgtcaaattataggatatgtaataggaactcaacaagctaccccagggcccgcatacagtggtcgagagataatataccccaatgcatccctgctgatccagaacatcatccagaacacaggattctacaccctacacgtcataaagtcagatcttgtgaaagaagcaactggccagttccgggtatacccggagctgcccaagccctccatctccagcaacaactccaaacccgtggaggacaaggatgctgtggccttcacctggactcaggacgcaacctacctgtggtgggtaaacaatcagagcctcccggtcagtcccaggctgcagctgtccaatggcaacaggaccctcactctattcaatgtcacaagaaaaacccagaacccagtgagtgccaggcgcagttcagtcatcctgaatgtcctctatggcccggatgcccccaccatttcccctctaaacacatcttacagatcaggggaaaatctgaacctctcctgccatgcagcctccccacctgcacagtactcttggtttgtcaatgggactttccagcaatccacccaagagctctttatccccaacatcactgtgaagaccacagtcacgacgatcacagtctatgcagagccacccaaacccttcatcaccagcaacaactccaaccccgtggaggagattcagaacacaacctacctgtggtgggtaaatcagagcctcccggtcagtcccaggctgcagctgtccaacaacaggaccctcactctactcagtgtcacaaggaagtgtggaatccagaacgaattaagtgtccacagcgacccagtcatcctgaatgtcctctatggcccagacgaccccaccatttccccctcatacacctattaccgtccaggggtgaacctcagcctctcctgccatgcagcctccccacctgcacagtattcttggctgattgggaacatccagcaacacacacaagagctctttatctccaacatcacgaagaacagcggactctatacctgccaggccaactcagccagtggccacagcaggactacagtcaagacaatcacagtctctgcggagctgcccaagccctccatctccagcaacaactccaaacccgtggaggacaaggatgctgtggccttcacctgggctcagaacacaacctacctgtggtgggtaaatggtcagagcctcccagtcagtcccaggctgcagctgtccaatggcaacaggaccctcactctattcaatgtcacaagaaacgcaagagcctatgtatgtggaatccagaactcagtgagtgcaaaccgcagcccagtcaccctggatgtcctctatgggccggacacccccatcatttcccccccagactcgtcttacctttcgggagcgaacctcaacctctcctgccactcggcctccccatccccgcagtattcttggcgtatcaatgggataccgcagcaacacacacaagttctctttatcgccaaaatcacgccaaattccatagtcaagagcatcacagtctctgcatctggaacttctcctggtctctcagctggggccactgtcggcatcatgattggagtgctggttggggttgctctgatatatga

SEQ ID NO: 328 - protein, 1167 aa, Homo sapiens [sequence omitted]

SEQ ID NO: 329 - DNA, 3504 bp, Homo sapiens
atgtggagctggcggccttgtgccgctgggggctcctcctcgccctcttgccccccggagccgcgagcacccaagtgtgcaccggcacagacaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagggcaggtcccactgcagaggctgcggattgtgcgaggcacccagctctttgaggacaactatgccctggccgtgcacaatggagacccgcacaataccacccctgtcacaggggcctccccaggaggcctgcgggagctgcagcttcgaagcctcacagagatcttccagcggaacccccagctctgctaccaggacacgattttgtggaaggacatcttccacaagaacaaccagctggctctcacacacaccaaccgctctcgggcctgccacccctgttctccgatgtgtaagggctcccgctgctggggagagagttctgaggattgtcagagcccgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgctgcctgtccctacaactacctttctacggacgtgggatcctgcaccctcgtctgccccctgcacaaccaagaggcagcagaggatggaacacagcggtgtgagaagtgcagcaagccctgtgcccgagtgtgctatggtctgggcatggagcacttgcgagagggggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtccggggacgaattctgcacaatggcgcctactcgcccctgcaagggctgggcatcagctggctggggctgcgctcacgggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgatgccaggcactgtttgccgtgccaccctgagtgtcagccccagaatggctcagcctgttttggaccggaggctgaccagtgtgtggcctgtgcccactataaggaccctcccttctgcgtggcccgctgccccagcggtgaacctgacctctcctacatgcccatctggaagtttccagatgaggagggcgcatgccagccttgccccatcaactgcacccactcctgtgtggacctggatgacaagggctgccccgccgagcagagagccagccctccgtccatcgtctctgcggtggttggcattctgctggtcgtggtcttgggggtggtctttgggatcctcatcaagcgacggcagcagaagatccggaagtacacgatgcggagactgctgcaggaaacggagctggtggagccgccacctagcggagcgatgcccaaccaggcgcagatgcggatccaggtgcttggatctggcgcttttggcacagtctacaagggcatctggatccctgatggggagaatggggaaaacacatcccccaaagccaacaaagaaatcttggctggtgtgggctccccatatgtctcccgccttctgggcatctgcccacagcttatgccctatggctgcctctaccatgtccgggaaaaccgcggacgcctgggctcccaggacctgcactggtgtatgcagattgccaaggggagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgcttttggggccaaaccttacgatgggatcccagcccgggagatccctgacctgctggaaaagggggagcggctgccccagccccccatctgcaccattgatgtctacattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggaccggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgccccccaccagccagatgttcggccccagcccccttcgccccgagagggccctctgcctgctgcccgacctgctggtgccactctggaaagggccaagactctctccccagggaagaatggggtcgtcaaagacgtttttgcctttgggggtgccgtggagaaccccgagtactcaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgttga

SEQ ID NO: 330 - protein, 1187 aa, Homo sapiens [sequence omitted]

SEQ ID NO: 331 - DNA, 3564 bp, Homo sapiens
atgggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctcttggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtggggctcccgctgctggggagagagttcggattgtcagagcctgacgcgcactgtctgtgccggtggctgtgcccgctgcaaggggccactgcccacgcagtgtgctgccggctgcacgggccccaagcactcctgcctggcctgcctccacttcaaccacagtggcatctggctgcactgcccagccctggtcacctacaacacagacacgttgtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtggaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttggggacccagcctccaacactgccccgctccagccagagcagctccaagtgttgactctggaagagatcacaggttacctatacatctcagcatggccggacagcctgcccctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccacccgtgtcagccccagaatggctcagtgacctgttttggaccggaggcggaccctcccttctgcgtggcccgctgccccagcggtgtgaaacccctctcctacatgcccatctggaagtttccagaggagggcgcatgccagccttgccccatcaactgcacccactcctgtgtggacctggacaagggctgccccgccgagcagagagccagccctctgacgtccatcgtctctgcggtggttggcattctgctggtcgtggtcttgggggtggtctttgggatcctcatcaagcgacggcagcagaagatccggaagtacacgatgcggagactgctgcaggaaacggagctggtggagccgctgacacccggagcgatgcccaaccaggcgcagatgcggatcctgaaagagacggagctgaggaaggtgaaggtgcttggatctggcgcttttggcacagtctacaagggcatctggatccctggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacatcgagacagagtaccatgcagatgggggcaaggtgcccatcaagtggatggcgctggagtccattctccgccggcggttcacccaccagagtgtgtggagttatggtgtgactgtgtgggagctgatgacttttggggccaaaccttacgatgggatcccagcccgggagatccccctgctggaaaagggggagcggctgccccagccccccatctgcaccattgtctacatgatcatggtcaaatgttggatgatatgtcggccaagattccgggagttggtgtcattctcccgcatggccagggacccccagcgctttgtggtcatccagaaggacttgggcccagccagtcccttggacagcaccttctaccgctcactgctggaggacgacatgggggacctggtggatgcggagtatctggtaccccagcagggcttcttctgtccagaccctgccccgggcgctgggggcatggtccaccacaggcaccgcagctcatctaccaggagtggcggtggggacctgacactagggctggagccctcagaggaggcccccaggtctccactggcaccctccgaaggggctggctccgatgtattcctgggaatgggggcagccaaggggctgcaaagcctccccacacatggctacgttgcccccctgacctgcagcccccagccatatgtgaaccagccagatgttcggccccagcccccttcgccccgagagggccctctgcctgctgcccgacctgctggtgccactctggaaagggccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgtga

SEQ ID NO: 332 - protein, 339 aa, Homo sapiens [sequence omitted]

SEQ ID NO: 333 - DNA, 1020 bp, Homo sapiens
atggagctgcacccctcctcctggccagggcagcaagctccttggcttcttgtttctgctttttttgctggcctttggtgtttcggcatggagaccgaagtcccattgacacctttcccactgaccccaaggaatcctcatggccacaaggatttggccaactcacccagctgggcatggagcagcattatgaacttggagagtataatgactcctataaacatgaacaggtttatattcgaagcacagacgttgaccggacttcaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagacttaatcagaggaattccagaagaggctgcacccttataaggattttactaccttgggaaaactttcaggattacatggccaggacctttttggaatttggagtaaagtctacgaccctttatattctgagagtgttcacaatttcactttaccctcctgggccactgaggacaccagagaattgtcagaattgtccctcctgtccctctatggaattcacaagcagaaagagaaatctaggctccaagggggtgtcctggtcaatgaaatcctcaatcacaagagagcaactcagataccaagctacaaaaaacttatcatgtattctgcgcatgacactactgatgtttacaacggactccttcctccctatgcttcttgccactcggaattgtactttgagaagggggagtactttgtggagatgtactaccggaatgagacgcagcacgagccgtatcccctcatgctacctggctgcagccccagctgtcctctggagaggtttgctgagctggttggccctgtccctcaagactggtccacggaggttaccacaaacagccatcaaggtactgaggacagtacagatttga

SEQ ID NO: 334 - protein, 319 aa, Homo sapiens [sequence omitted]

SEQ ID NO: 335 - DNA, 960 bp, Homo sapiens
atggagagctgcacccctcctcctggccagggcagcaagcttagccttggcttcttgtttctgctttttttgctggctagaccgaagtgtactagccaaggagttgaagtttgtgactttggtgtttcggcatggagaccgaagtcccatccccataaaggaatcctcatggccacaaggatttggccaactcacccagctgggcatggagcagcattaacttggagagtatataagaaagagataccggactttgatgagtcgtatgacaaacctggcagccctgtttcccccagaaggtgtcagcatctggaatcctatcctactctggcagcccatcccggtgcacacagttcctctttcagatcagttgctatacctgcctttcaggaactgccctcgttttcaagaactgactttgaaatcagaggaattccagaagaggctgcacccttaggattttatagctaccttgggaaaactttcaggattacatggccaggacctttttggaatttggaggagtgttcacaatttcactttaccctcctgggccacgttgagagaattgtcagaattgtccctcctgtccctctatggaattcacaagcagaaagagaaatcaatcctcaatcacatgaagagagcaactcagataccaagctacaaaaaacttatcatgtattctgcgcacactactgtgactggcctacagatggcgctagatgtttacaacggactccttcctccctatgcttcttgccacttgacggaattgtacttgaagggggagtactttgtggagatgtactaccggaagacgcagcacgagccgtatcccctcatgctacctggctgcagccccagctgtcctctggagaggtttgcgctggttggccctgtgatccctcaagactggtccacggaggttatgaccacaaacagccatcaaggtactga

SEQ ID NO: 336 - protein, 1084 aa, Homo sapiens [sequence omitted]

SEQ ID NO: 337 - DNA, 3255 bp, Homo sapiens
atgtgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgccaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctcctggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagcgcgtgcgggactgcgcttggctgcgcaggagcccaggggttggctgtgttccggccgcagagcaccgtctgcgtgaggagatcctggccaagttcctgcactggcgtgtgtacgtcgtcgagctgctcaggtctttcttttatgtcacggagaccacgtttcaaaagaacaggctctttttctaccggaagagtgtctggagcaagttgcaaagcattggaatcagacagcactagagggtgcagctgcgggagctgtcggaagcagaggtcaggcagcatcgggaagccaggcccgccctgccgtccagactccgcttcatccccaagcctgacgggctgcggccgattgacatggactacgtcgtgggagccagaacgttccgcagagaaaagagggccgagcgtctcacctcgagggaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgcgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctacctcagacctccagccgtacatgcgacagttcgtggctcacctgcaggagaccagcccgcgggatgccgtcgtcatcgagcagagctcctcccatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggcacctcacctcacccacgcgaaaaccttcctcaggaccctggtccgaggtgtccctgagtatggctgcgtggaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggcagtgtcacagcctgtttctggatttgcaggacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatccaagccaagaacgcagggatgtcgctgggggccaagggcgccgccggccctctgccctccgaggccgtgcagtggctgtgccaccaagcattcctgctcaagcctcgacaccgtgtcacctacgtgccactcctggggtcactcaggacagcccagacgcagcctgccctggaggccgcagccaacccggcactgccctcagacttcaagaccatcctggacttga

SEQ ID NO: 338 - protein, 1122 aa, Homo sapiens [sequence omitted]

SEQ ID NO: 339 - DNA, 3369 bp, Homo sapiens
atggccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctggaccccgaaggcgtctgggatgcgaacgggcctggaaccacgtcagggaggccggggtccccctgggcctgccagccccgggtgcgaggaggcgcgggggcagtgccagccgaagtctgccgttgcccaagaggcccaggcgtggcgctgccccgccggagcggacgcccgttgggcaggggtcctgggcccacccgggcaggacgcgtggaccgagccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcccgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgccgctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatttcttgttggtgacacctcacctcacccacgcgaaaaccttcctcaggaccctggtccgaggtgtcccgtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctccacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgtga

SEQ ID NO: 340 - protein, 994 aa, Homo sapiens [sequence omitted]

SEQ ID NO: 341 - DNA, 2985 bp, Homo sapiens
atgtgtcctttcgggcagccaggctcagcaggaacagaaggaatgacactctggacagcacccggaccctgtactccagcgcgtctcggagcacagacttgtcttacagtgaaagcgacttggattttattcaagcaaattttaagaaacgagaatgtgtcttctttatcaaagattccaaggccacggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgcagccgcgcatgcgcaagatcttcagccggctcatctacatcgcgcagtccaaaggtgcttggattctcacgggaggcacccattatggccgagataacaccatcagcaggagttcagaggagaatattgtggccattggcacagcttggggcatggtctccaaccgggacaccctcatcaggaattgcgatgctgagggctatttttcccagtaccttatggatgacttcacaagagatccactgtatatcctggacaacaaccacacacatttgctgctcgtggacaatggctgtcatggacatcccactgtcgaagcaaagctccggaatcagcagaagtatatctctgagcgcactattcaagattccaactatggtggcaagatccccattgtgtgttttgcccaaggaggtggaaaagagacttaagccatcaatacctccatcaaaaataaaattccttgtgtggtggtggaaggctcgggccagatcgctgatgtcgctagcctggtggaggtggaggatgccccatcttctgccgtcaaggagaagctggtgcgctttttaccccgcacggtgtcccggctgcctgaggaggagactgagagttggatcaaatggctcaaagaaattctcgaatgttctcacctatcagttattaaaatggaagaagctggggatgaaattggcaatgccatctcctacgctctatacaaagccttcagcaccagtgagcaagacaaggataactggaatgggcagcagcttctgctggagtggaaccagctggactccaatgatgagattttcaccaatgaccgccgatgggagtctgctgaccttcaagaagtcatgtttacggctctcaaggacagacccaagtttgtccgcctctttctggagaatggctacctacggaagtttctcacccatgatgtcctcactgaactcttctccaaccacttcagcacgcttgtgtaccggaatctgcagatcgccaagaattcctataatgatgccctcctcacgtttgtctggaaactggttgcgaacttccgaagaggcttccggaaggaagacagaaatggccgggacgagatggacaaactccacgacgtgtctcctattactcggcaccccctgcaagctctcttcatctgggccattcttcagaataagaaggaactctccaaagtcatttgggagcagaccaggggctgcactctggcagccctgggagccagcaagcttcagaacgacatcaatgctgctggggagtccgaggagctggctaatgagtacgagacccgggctgttgagctgttcactgagtgttacagcagcgatgaagacttggcagaacagctgctggtctattcctgtgaagcttggggtggaagcaactgtctggagctggcggtggaggccacagaccagcatttcatcgcccagcctggggtccagaattttctttctaagcaatggtatggagagatttcccgagacaccaagaactggaagattatcctgtgtctgtttattatacccttggtgggctgtggctttgtatcatttaggaagaaacctgtcgacaagcacaagaagctgctttggtactatgtggcgttcttcacctcccccttcgtggtcttctcctggaatgtggtcttctacatcgccttcctcctgctgtttgcctacgtgctgctcatggatttccattcggtgccacacccccccgagctggtcctgtactcgctggtctttgtcctcttctgtgatgaagtggacacgctggggcttttttacttcacaggaattgtatttcggctccactcttctaataaaagctctttgtattctggacgagtcattttctgtctggactacattattttcactctcgatgtgttcttcttcctgttcctctttgcggtgtggatggtggcctttggcgtggccaggcaagggatccttaggcagaatgagcagcgctggaggtggatattccgttcggtcatctacgagccctacctggccatgttcggccaggtgcccagtgacgtggatggtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggagaagtgcttcaagtgttgctgcaaggagaaaaacatggagtcttctgtctgctgtttcaaaaatgaagacaatgagactctggcatgggagggtgtcaaggaaaactaccttgtcaagatcaacacaaaagccaacgacacctcagaggaaaggcatcgatttagacaactggatacaaagcttaatgatctcaagggtcttctga

SEQ ID NO: 342 - protein, 980 aa, Homo sapiens [sequence omitted]

SEQ ID NO: 343 - DNA, 2943 bp, Homo sapiens
atggtcctttcgggcagccaggctcagcatgaggaacagaaggaacactctggacagcacccggaccctgtactccagcgcgtctcggagcacagacttgtcttacagaagcgacttggtgaattttattcaagcaaatttgaaacgagaatgtgtcttctttatcaaagattccaaggccacggagaatgtgtgcaagtgtggctatgcccagagccagcacatggaaggcacccagatcaaccaaaggaaatggaactacaagaaacacaccaaggaatttcctaccgacgcctttggggatattcagttgacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgatgaagtacatcggggaggtggtgagagacaccatcagcaggagttcagaggagaatattgtggccattggcatagcagcttggggcatggtctccaaccgggacaccctcatcaggaattgcgatgcgggctattttttagcccagtaccttatggacttcacaagagatccactgtatatcctggacaacaaccacacacatttgctgctcgtggacaatggctgtcatggacatcccactgtcgaagcaaagctccggaatcagctagagaagtatatctcgcgcactattcaagattccaactatggtggcaagatccccattgtgtgttttgcccaaggaggtggaaaagagactttgaaagccatcaatacctccatcaaaaaaattccttgtgtggtggtggaaggctcgggccagatcgccctggtggaggtggaggatgccctgacatcttctgccgtcaaggagaagctggtgcgctttttaccccgcacggtgtcccggctgccgagttggatcaaatggctcaaagaaattctcgaatgttctcacctattaacagttataattgtgagcaatgccatctcctacgctctatacaaagccttcagcaccagctggaatgggcagctgaagcttctgctggagtggaaccagctggacttagccaaccttcaagaagtcatgtttacggctctcataaaggacagacccaagtttgtccgcctctttctggagaatggcttgaacctacggaagtttctcacccaactcttctccaaccacttcagcacgcttgtgtaccggaatctgcagatcgccaagaattcctatgccctcctcacgtttgtctggaaactggttgcgaacttccgaagaggcttccggaaggaagacagaaatggccgggacgagatggacatagaactccacgacgtgtctcctattactcggcaccccctgcaagctctcttcatctgggccattcttcagaagaaggaactctccaaagtcatttgggagcagaccaggggctgcactctggcagccctgggagccagcaagcttctgaagactctggccaaagtgaagaacgacatcaatgctgctggggagtccgaggagctggcagacttggcagaacagctgctggtctattcctgagcttggggtggaagcaactgtctggagctggcggtggaggccacagaccagcatttcatcgcccagcctggggtccagaattttctttcgcaatggtatggagagatttcccgagacaccaagaactggaagattatcctgtgtctgtttattatacccttggtgggctgtggctttgtatcattgaagaaacctgtcgacaagcacaagaagctgctttggtactatgtggcgttcttcacctcccccttcgtggtcttctcctggaatgtggtcttctacatcgccttcctcctgctgtttgcctacgtgctgctcatggatttccattcggtgccacacccccccgagctggtcctgtactcgctggtctttgtcctcttctgagtgagacagtggtacgtaaatggggtgaattattttaccctgtggaatgtgatggacacgctggggcttttttacttcatagcaggaattgtatttcggctccactcttcaagctctttgtattctggacgagtcattttctgtctggactacattattttcactctaagattgatccacatttttactgtaagcagaaacttaggacccaagattataatgctgcagaggatgctgatcgatgtgttcttcttcctgttcctctttgcggtgtggatggtggcctttggcgtggccaggcaagggatcctgcagcgctggaggtggatattccgttcggtcatctacgagccctacctggccatgttcggccaggtgcccagctttgcccactgcaccttcactgggaagtccaagccactgtgtgtggagctggagcacaacctgccccggttccccgagtggatcaccatccccctggtgtgcatctacatgttatccaccaacatcctgctggtcaacctgctggtcgccatgtttggctacacggtgggcaccgtccaggagaacaaccaggtctggaagttccagaggtacttcctggtgcaggagtactgcagccgcctcaatatccccttccccttcatcgtcttcgcttacttctacatggtggtgaagaagtgcttcaagtgttgctgcaaggagaaaaacatggagtcttctgtctgctgtttcaaaaagactctggcatgggagggtgtcatgaaggaaaactaccttgtcaagatcaacacaaaagccaacgacacctcagaggaaatgaggcatcgatttga

SEQ ID NO: 344 - protein, 750 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 345 - DNA, 2653 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatataaaaaaaaaaaaaaaaaaa

SEQ ID NO: 346 - protein, 652 aa, Homo sapiens [sequence omitted]

SEQ ID NO: 347 - DNA, 1959 bp, Homo sapiens
atgtgtggaatctccttcacgaaaccgactcggctgtggccaccgcgcgccgcccgcgctggctgtgcgctggggcgctggtgctggcgggtggcttctttctcctcggcttcctcttcgggtggtttaaatcctccaatgaagctactaacattactccaaagcataataaagctgagaacatcaagaagttcttatataattttacacagataccacattcaggaacagaacaaaactttcagcttgcaaagcaaattcaatcccagtggaaagaatttggcctggattctgttgagccacattatgatgtcctgttgtcctacccaaataagactcatcccaactacatctcaattaatgaagatggaaatgagattttcaacacatcattatttgaaccacctcctccaggatatgaaaatgtttcggatattgtaccacctttcagtgctttctctcctcaaggaatgccagagggcgatctgtatgttaactatgcacgaactgaagacttctttaaattggaacgggacattgccagatatgggaaagttttcagaggaaataaggttaaaaatgcccagctggcaggggccaaaggagtcattctctactccgaccctgctgactactttgctcctggggagtcctatccagatggttggaatcttcctggaggtggtgtccagcgtggaaatatccatggtgcaggagaccctctcacaccaggttacccagcaaatgaatatgcttataggcgtggaattgcagaggctgttggtcttccaagtattcctgttcatccaattggatactatgatgcacagaagctccaaaaaatgggtggctcagcaccaccagatagcagctggagaggaagtctcaaagtgccctacaatgttggacctggctttactggaaacttttctacacaaaaagtcaagatgcacatccactctaccaatgaaggtactctcagaggagcagtggaaccagacagatatgtcattctgggaggtcaccgggactcatgggtgtttggtggtattgaccctcagagtggagcagctgttgttcatgaaattgaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctaaaagccctgatgaaggctttgaaggcaaatctctttatgaaagttggactaaaaaaagtccttccccagagttcagtggcatgcccaggagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctgctcccttttgattgtcgagattatgctggaaagtatgctgacaaaatctacagtatttctaagacatacagtgtatcatttgattcacttttttctgcagagaattttacagaaattgcttccaagttcagtgagagactccaggactttgacaaaagcaacccaaatgatcaactcatgtttctggaaagagcatttattgatccatggttaccagacaggcctttttataggcatgtcatctatgctccaagcagccacaacaagtatgcaggggagtcattcccaggaatttatgatgctctgtttgatattgaaagcaaagtggacccttccaaggcctggggagaagagagacagatttatgttgcagccttcacagtgcaggcagctgcagagactttga

SEQ ID NO: 348 - protein, 598 aa, Homo sapiens [sequence omitted]

SEQ ID NO: 349 - DNA, 1797 bp, Homo sapiens
atggtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaattttacacagataccacatttagcaggaacagaacaaaactttcagcttgcaaagcaaattcaatcccagtggaaagaatttggcctggattctgtgactcatcccaactacatctcaataataaatgtttcggatattgtaccacctttcagtgctttctctcctcaaggaatgccagagggcgatctagtgtatgtattggaacgggacatgaaaatcaattgctctgggaaaattgtaattgccagatatgggaaagttttcagaggaaaaaatgcccagctggcaggggccaaaggagtcattctctactccgaccctgcctactttgctcctggggtgaagtcctatccagatggttggaatcttcctggaggtggtgtccagcgtggaaatatcctaaatctgaatggtgcaggagaccctctcacaccaggttacccagcaaagcgtggaattgcagaggctgttggtcttccaagtattcctgttcatccaattggatactatgcacagaagctcctagaaaaaatgggtggctcagcaccaccagacagctggagaggaagtctcaaagtgccctacaatgttggacctggctttactggaaacttttctacacaaaaagtcaagatgcacatccactctaccaaagtgacaagaatttacaatgtgataggtactctcagaggagcagtggaaccagacagatatgtcattctgggaggtcaccgggactcatgggtgtttggtggtatccctcagagtggagcagctgttgttcaaattgtgaggagctttggaacactgaaaaaggaagggtggagaccaagaacaattttgtttgcaagctgggatgcagaagaatttggtcttcttggttctacgtgggcagaggagaattcaagactccttcaagagcgtggcgtggcttatatctcatctatagaaggaaactacactctgagagtttgtacaccgctgatgtacagcttggtacacaacctaacaaaagagctgaaaagcccaaaaagtccttccccagagttcagtggcatgcccaggataagcaaattgggatctggaaaggtgttcttccaacgacttggaattgcttcaggcagagcacggtatacaaattgggaaacaaacaaattcagcggctatccactgtatcacagtgtctaatatcacctcactgtggcccaggttcgaggagggatggtgttgctagccaattccatagtgctccctttttgtcgagattatgctgtagttttaagaaagtatgccaaaatctacagtatttctatgaaacatccacaggaaatgaagacatacagtgtatcattttcacttttttctgcagtaaagaattttacagaaattgcttccaagttcagcaaaagcaacccaatagtattaagaatgatgaatcaactcatgtttctggaaagagcatttattccattagggttaccagacaggcctttttagcatgtcatctatgctccaagcagccacaacaagtatgcaggggagtcattcccaggaatttaaagcaaagtggacccttccaaggcctggggagaagtgaagagacagatttatgttgcagccttcacagtgcaggcagctgcagagactttgagtga

SEQ ID NO: 350 - protein, 42 aa, Homo sapiens
CGISFTKPTRLWPPRAARAGCALGRWCWRVASFSSASSSGGL

SEQ ID NO: 351 - protein, 46 aa, Homo sapiens
VESPSRNRLGCGHRAPPALAVRWGAGAGGWLLSPRLPLRVVYKILQ

SEQ ID NO: 352 - protein, 11 aa, Homo sapiens
MKLLTLLQSII

SEQ ID NO: 353 - protein, 17 aa, Homo sapiens
MMSCCPTQIRLIPTTSQ

SEQ ID NO: 354 - protein, 42 aa, Homo sapiens
MKMEMRFSTHHYLNHLLQDMKMFRILYHLSVLSLLKECQRAI

SEQ ID NO: 355 - protein, 16 aa, Homo sapiens
MLTMHELKTSLNWNGT

SEQ ID NO: 356 - protein, 34 aa, Homo sapiens
MGKFSEEIRLKMPSWQGPKESFSTPTLLTTLLLG

SEQ ID NO: 357 - protein, 15 aa, Homo sapiens
MVGIFLEVVSSVEIS

SEQ ID NO: 358 - protein, 44 aa, Homo sapiens
MVQETLSHQVTQQMNMLIGVELQRLLVFQVFLFIQLDTMMHRSS

SEQ ID NO: 359 - protein, 24 aa, Homo sapiens
MLDLALLETFLHKKSRCTSTLPMK

SEQ ID NO: 360 - protein, 28 aa, Homo sapiens
MSFWEVTGTHGCLVVLTLRVEQLLFMKL

SEQ ID NO: 361 - protein, 34 aa, Homo sapiens
MQKNLVFLVLLSGQRRIQDSFKSVAWLILMLTHL

SEQ ID NO: 362 - protein, 27 aa, Homo sapiens
MKALKANLFMKVGLKKVLPQSSVACPG

SEQ ID NO: 363 - protein, 68 aa, Homo sapiens
MILRCSSNDLELLQAEHGILKIGKQTNSAAIHCITVSMKHMSWWKSFMIQCLNITSLWPRFEEGWCLS

SEQ ID NO: 364 - protein, 9 aa, Homo sapiens
MLTKSTVFL

SEQ ID NO: 365 - protein, 14 aa, Homo sapiens
MINSCFWKEHLLIH

SEQ ID NO: 366 - protein, 39 aa, Homo sapiens
MSSMLQAATTSMQGSHSQEFMMLCLILKAKWTLPRPGEK

SEQ ID NO: 367 - protein, 13 aa, Homo sapiens
MLQPSQCRQLQRL

SEQ ID NO: 368 - protein, 261 aa, Homo sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 369 - DNA, 1446 bp, Homo sapiens
attccgccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggtaccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatacgtg

SEQ ID NO: 370 - protein, 253 aa, Homo sapiens [sequence omitted]

SEQ ID NO: 371 - DNA, 762 bp, Homo sapiens
atgtgtgggtcccggttgtcttcctcaccctgtccgcgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtcttgctgggtcggcacagcctgtttcatcctgaagacacaggccaggtatttcaggtcagccacagcttcccacacccgctctacgataagaatcgattcctcaggccaggtgatgactccagccacgacctcatgctgctccgcctgtcagagcctgccgagctcacggatgctgaggtcatggacctgcccacccaggagccagcactggggaccacctgctacgcctcaggctggggcagcattgaaccagaggagttctccccaaagaaacttcagtgtgtggacctccatgttatttccaatgacgtgtgtgcgcaagttcaccctcagaaggccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaaccccttga

SEQ ID NO: 372 - protein, 247 aa, Homo sapiens [sequence omitted]

SEQ ID NO: 373 - DNA, 744 bp, Homo sapiens
atggtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatccagacacaggccaggtatttcaggtcagccacagcttcccacacccgctctacgatatgagcctcctgaagaatcgattcctcaggccaggctccagccacgacctcatgctgctccgcctgtcagagcctgccgagctcacggatgctgtgaaggtcatggacctgcccacccaggagccagcactggggaccacctgctacgcctcaggctggggcagcataccagaggagttcttgaccccaaagaaacttcagtgtgtggacctccatgttatttccaacgtgtgtgcgcaagttcaccctcagaaggtgaccaagttcatgctgtgtgctggacgctggacagggggcaaaagcacctgctcgggtggtgtgcttcaaggtatcacgtcatggggcagaccatgtgccctgcccgaaaggccttccctgtacaccaaggtggtgcattaccggaagtggatcaaggacaccatcgtggccaacccctgtga

SEQ ID NO: 374 - protein, 11 aa, Homo sapiens
CGSRLSSSPCP

SEQ ID NO: 375 - protein, 82 aa, Homo sapiens
VGPGCLPHPVRDVDWCCTPHPVSDCGRLGVREAFPTLAGACGLSWQGSLRRCSGAPPVGPHSCPLHQEQKRDLAGSAQPVSS

SEQ ID NO: 376 - protein, 21 aa, Homo sapiens
MTPATTSCCSACQSLPSSRML

SEQ ID NO: 377 - protein, 15 aa, Homo sapiens
MLFPMTCVRKFTLRR

SEQ ID NO: 378 - protein, 42 aa, Homo sapiens
MVCFKVSRHGAVNHVPCPKGLPCTPRWCITGSGSRTPSWPTP

SEQ ID NO: 379 - protein, 28 aa, Homo sapiens
MCPARKAFPVHQGGALPEVDQGHHRGQP

SEQ ID NO: 380 - protein, 393 aa, Homo sapiens [sequence omitted]

SEQ ID NO: 381 - DNA, 1303 bp, Homo sapiens
gtccaggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcgactcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactga

SEQ ID NO: 382 - protein, 383 aa, Homo sapiens [sequence omitted]

SEQ ID NO: 383 - DNA, 1152 bp, Homo sapiens
atgtggaggagccgcagtcagatcctagcgtcgagccccctcgtcaggaaacattttcagacctatggaaactacttcctgaaaacaacgttctgtcccccttgccgtcccaagcaatggatgatttgctgtccccggacgatattgaacaatggttcactgaagacccaggtccagatgaagctcccagaatgccagaggctgctccccccgtggcccctgcaccagcgactcctacaccggcggcccctgcaccagccccctcctggcccctgtcatcttctgtcccttcccagaaaacctaccagggcagctacggtttccgtctgggcttcttgcattctgggacagccaagtctgcttgcacgtactcccctgccctcaacaagatgttttgccaactggccaagacctgccctgtgcagctgtgggttgattccacacccccgcccggcacccgcgtccgcgccatggccatctacaagcagtcacagcacaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagcatgaggccttggaactcaaggatgcccaggctgggaaggagccaggggggagcagggctcactccagccaccagtccaaaaagggtcagtctacctcccgccataaaaaactcatgttcaagacagaagggcctgactcagacttga

SEQ ID NO: 384 - protein, 318 aa, Homo sapiens [sequence omitted]

SEQ ID NO: 385 - DNA, 957 bp, Homo sapiens
atgcgtcgagccccctctgagtcaggaaacattttcagacctatggaaactacttccaaacaacgttctgtcccccttgccgtcccaagcaatggaagctcccagaatgccagaggctgctccccccgtggcccctgcaccagcgactcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggtttccacacccccgcccggcacccgcgtccgcgccatggccatctacaagcagtcacagcacatgacggaggttgtgaggcgctgcccccaccacgatggtctggcccctcctcagcatcttatccgagtggaaggaaatttgcgtgtggagtatttggactgtaccaccatccactacaactacatgtgcagttcctgcatgggcggcatgaaccggaggcccatcctcaccatcatcacactggaagactccagtggggtgcgtgtttgtgcctgtcctgggagagaccggcgcacagaggaagagaatctccgcaagaaaggggagcctcaccacgagctgcccccagggagcacgcgagcactgcccaacaacaccagctcctctccccagccaaagaagaaaccactggatggagaatatttcacccttcagatccgtgggcggcgcttcgagatgttccgagagctgaaggccttggaactcaaggatgcccaggctgggaaggagccaggggggagcagggctcactccagccacctgaagtccaaaaagggtcagtctacctcccgccaaaaactcatgttcaagacagaagggcctga

SEQ ID NO: 386 - protein, 13 aa, Homo sapiens
WRSRSQILASSPL

SEQ ID NO: 387 - protein, 61 aa, Homo sapiens
MKLPECQRLLPPWPLHQRLLHRRPLHQPPPGPCHLLSLPRKPTRAATVSVWASCILGQPSL

SEQ ID NO: 388 - protein, 67 aa, Homo sapiens
MSAAQIAMVWPLLSILSEWKEICVWSIWMTETLFDIVWWCPMSRLRLALTVPPSTTTTCVTVPAWAA

SEQ ID NO: 389 - protein, 20 aa, Homo sapiens
MENISPFRSVGVSASRCSES

SEQ ID NO: 390 - protein, 24 aa, Homo sapiens
MRPWNSRMPRLGRSQGGAGLTPAT

SEQ ID NO: 391 - protein, 1280 aa, Homo sapiens [sequence omitted]

SEQ ID NO: 392 - DNA, 4646 bp, Homo sapiens
cctactctattcagatattctccagattcctaaagattagagatcatttctcattctcctaggagtactcacttcaggaagcaaccagataaaagagaggtgcaacggaagccagaacattcctcctggaaattcaacctgtttcgcagtttctcgaggaatcagcattcagtcaatccgggccgggagcagtcatctgtggtgaggctgattggctgggcaggaacagcgccggggcgtgggctgagcacagcgcttcgctctctttgccacaggaagcctgagctcattcgagtagcggctcttccaagctcaaagaagcagaggccgctgttcgtttcctttaggtctttccactaaagtcggagtatcttcttccaagatttcacgtcttggtggccgttccaaggagcgcgaggtcgggatggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaagttgtatatggtggtgggaactttggctgccatcatccatggggctggacttcctctcatgatgctggtgtttggagaaatgacagatatctttgcaaatgcaggaaatttagaagatctgatgtcaaacatcactaatagaagtgatatcaatgatacagggttcttcatgaatctggaggaagacatgaccaggtatgcctattattacagtggaattggtgctggggtgctggttgctgcttacattcaggtttcattttggtgcctggcagctggaagacaaatacacaaaattagaaaacagttttttcatgctataatgcgacaggagataggctggtttgatgtgcacgatgttggggagcttaacacccgacttacagatgatgtctctaagattaatgaagttattggtgacaaaattggaatgttctttcagtcaatggcaacatttttcactgggtttatagtaggatttacacgtggttggaagctaacccttgtgattttggccatcagtcctgttcttggactgtcagctgctgtctgggcaaagatactatcttcatttactgataaagaactcttagcgtatgcaaaagctggagcagtagctgaagaggtcttggcagcaattagaactgtgattgcatttggaggacaaaagaaagaacttgaaaggtacaacaaaaatttagaagaagctaaaagaattgggataaagaaagctattacagccaatatttctataggtgctgctttcctgctgatctatgcatcttatgctctggccttctggtatgggaccaccttggtcctctcaggggaatattctattggacaagtactcactgtattcttttctgtattaattggggcttttagtgttggacaggcatctccaagcattgaagcatttgcaaatgcaagaggagcagcttatgaaatcttcaagataattgataataagccaagtattgacagctattcgaagagtgggcacaaaccagataatattaagggaaatttggaattcagaaatgttcacttcagttacccatctcgaaaagaagttaagatcttgaagggcctgaacctgaaggtgcagagtgggcagacggtggccctggttggaaacagtggctgtgggaagagcacaacagtccagctgatgcagaggctctatgaccccacagaggggatggtcagtgttgatggacaggatattaggaccataaatgtaaggtttctacgggaaatcattggtgtggtgagtcaggaacctgtattgtttgccaccacgatagctgaaaacattcgctatggccgtgaaaatgtcaccatggatgagattgagaaagctgtcaaggaagccaatgcctatgactttatcatgaaactgcctcataaatttgacaccctggttggagagagaggggcccagttgagtggtgggcagaagcagaggatcgccattgcacgtgccctggttcgcaaccccaagatcctcctgctggatgaggccacgtcagccttggacacagaaagcgaagcagtggttcaggtggctctggataaggccagaaaaggtcggaccaccattgtgatagctcatcgtttgtctacagttcgtaatgctgacgtcatcgctggtttcgatgatggagtcattgtggagaaaggaaatcatgatgaactcatgaaagagaaaggcatttacttcaaacttgtcacaatgcagacagcaggaaatgaagttgaattagaaaatgcagctgatgaatccaaaagtgaaattgatgccttggaaatgtcttcaaatgattcaagatccagtctaataagaaaaagatcaactcgtaggagtgtccgtggatcacaagcccaagacagaaagcttagtaccaaagaggctctggatgaaagtatacctccagtttccttttggaggattatgaagctaaatttaactgaatggccttattttgttgttggtgtattttgtgccattataaatggaggcctgcaaccagcatttgcaataatattttcaaagattataggggtttttacaagaattgatgatcctgaaacaaaacgacagaatagtaacttgttttcactattgtttctagcccttggaattatttcttttattacatttttccttcagggtttcacatttggcaaagctggagagatcctcaccaagcggctccgatacatggttttccgatccatgctcagacaggatgtgagttggtttgatgaccctaaaaacaccactggagcattgactaccaggctcgccaatgatgctgctcaagttaaaggggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggtgctgggaagatcgctactgaagcaatagaaaacttccgaaccgttgtttctttgactcaggagcagaagtttgaacatatgtatgctcagagtttgcaggtaccatacagaaactctttgaggaaagcacacatctttggaattacattttccttcacccaggcaatgatgtatttttcctatgctggatgtttccggtttggagcctacttggtggcacataaactcatgagctttgaggatgttctgttagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagatcgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgaactctgactgtatgagatgttaaatactttttaatatttgtttagatatgacatttattcaaagttaaaagcaaacacttacagaattatgaagaggtatctgtttaacatttcctcagtcaagttcagagtcttcagagacttcgtaattaaaggaacagagtgagagacatcatcaagtggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtg

SEQ ID NO: 393 - protein, 1085 aa, Homo sapiens [sequence omitted]

SEQ ID NO: 394 - DNA, 3258 bp, Homo sapiens
atgtggatcttgaaggggaccgcaatggaggagcaaagaagaagaacttttttaaacacaataaaagtgaaaaagataagaaggaaaagaaaccaactgtcagtgtattttcaatgtttcgctattcaaattggcttgacaagttgtatatggtggtgggaactttggctgccatcatccatggggctggacttcctctcacagatatctttgcaaatgcaggaaatttgtcaaacatcactaatagaagtgatatcaatgatacagggttcttcaccaggtatgcctattattacagtggaattggtgctggggtgctggttgctgcttacattcaggtttcattttggtgcctggcagctggaagacaaatacacaaaattagaaaacagttttttcatgctagctggtttgatgtgcacgatgttggggagcttaacacccgacttacagatgatgtctctaagattaatgaagttattggtgacaaaattggaatgttctttcagtcaatggcaacatttttcactgggtttagatttacacgtggttggaagcttttggccatcagtcctgttcttggactgtcagctgctgtctgggcaaagatactatcttcatttactgataaagaactctctgaagaggtcttggcagcaattagaactgttgcatttggaggacaaaagaaagaacttgaaaggtacaacaaaaattagaaagctattacagccaatatttctagtgctgctttcctgctctatgcatcttatgctctggccttctggtatgggaccaccttggtcctctcaggggaatattctattggacaagtactcactgtattcttttctgtatttggggcttttagtgttggacaggcatctccaagcattgaagcatttgcaaatgcaagaggagcagcttatgaaatcttcaagattgataataagccaagtattgacagctattcgaagagtgggcacaaaccagataatattaagggaaatttggaattcagaaatgttcacttcagttacccatctcgaaaagaagttaagatctaggtgcagagtgggcagacggtggccctggttggaaacagtggctgtgggaagagcacaacagtccagctgcagaggctctatgaccccacagaggggatggtcagtgttgatggacaggatattaggaccaggtttctacgggaaatcattggtgtgggtcaggaacctgtattgtttgccaccacgactgaaaacattcgctatggccgtgaaaatgtcaccatggatgagattgagaaagctgtcaaggaagccaatgcctatgactttatcaaactgcctcataaatttgacaccctggttggagagagaggggcccagtgtggtgggcagaagcagaggatcgccattgcacgtgccctggttcgcaaccccaagatcctcctgctggatgaggccacgtcagccttggacacagaaagcgaagcagtggttcaggtggctctggataaggccagaaaaggtcggaccaccattgctcatcgtttgtctacagttcgtaatgctgacgtcatcgctggtttcgatgatggagtcattgtggagaaaggaaatcatgatgaactcaaagagaaaggcatttacttcaaacttgtcacaatgcagacagcaggaaatgaagttgaataaaatgcagctgatgaatccaaaagtgaaattgatgccttggaaatgtcttcaaatgattcaagatccagtcgaaaaagatcaactcgtaggagtgtccgtggatcacaagcccaagacagaaagcttagtaccaaagaggctctggatgaaagtatacctccagtttccttttggaggattactgaatggccttattttgttgttggtgtattttgtgccattaatggaggcctgcaaccagcatttgcaagggtttttacaagaattgatgatcctgaaacaaaacgacagaatagtaacttgttttcactattgtttccccttggaattatttcttttattacatttttccttcagggtttcacatttggcaaagctggagagatcctcaccaagcggctccgatacatggttttccgatccatgctcagacaggatggttggtttgatgaccctaaaaacaccactggagcatctaccaggctcgccaatgatgctgctcaagttaaaggggctattatatccttcatctatggttggcaacaaggtgctgggaagatcgctactgaagcaactcaggagcagaagtttgaacatatgtatgctcagagtttgcaggtaccatacagaaactcttggaaagcacacatctttggaattacattttccttcacccaggcaatgtatttttcctatgctggatgtttccggtttggagcctacttggtggcacataaactcatattttcagctgttgtctttggtgccatggccgtggggcaagtcagttcatttgctcctgactatgccaaagccaaaatatcagcagcccacatcatcatgccgaacacattggaaggaaatgtcacatttggtgaagttgtattcaactatcccacccgaccggacatcccagtgcttcagggacagaagggccagacgctggctctggtgggcagcagtggctgtgggaagagcacagtggtccagctcctggagcggttctacgaccccttggcagggaaagtgctgcttgatggcaaagaaaatgttcagtggctccgagcacacctgggcatcgtgtcccaggagcccatcctgtttgactgcagcattgctgagaacattgcctatggagacaacagccgggtggtgtcacaggaagagatcggggcagcaaaggaggccaacatacatgccttcatcgagtcactgcctaataaatatagcactaaaggagacaaaggaactcagctctctggtggccagaaacaacgcattgccactcgtgcccttgttagacagcctcatattttgcttttggatgaagccacgtcagctctggatacagaaagtgaaaaggttgtccaagaagccctggacaaagccagagaaggccgcacctgcattgttgctcaccgcctgtccaccatccagaatgcagacttggtgtttcagaatggcagagtcaaggagcatggcacgcatcagcagctgctggcacagaaaggcatctatttttcaatggtcagtgtccaggctggaacaaagcgccagttga

SEQ ID NO: 395 - protein, 1050 aa, Homo sapiens [sequence omitted]

SEQ ID NO: 396 - DNA, 3153 bp, Homo sapiens
atgaggggaccgcaatggaggagcaaagaagaagaactttttgaaggaaaagaaaccaactgtcagtgtattttcaatgtttcgctattcaaattggctcaagttgtatatggtggtgggaactttggctgccatcatccatggggctggacttcctctcatgatgctggtgtttggagaaatgacagatatctttgcaaatgcaggaaatttagaagatctgatgtcaaacatcacaagtatcaatacagggttcttcatgaatctggaggaagacatgaccaggtatgcctattattacagtggaattggtgctggggtgctggttgctgcttacattcaggtttcattttggtgcctggcagctggaagacaaatacacaaaataaaacagttttttcatgctataatgcgacaggagataggctggttcaaaattggaatgttctttcagtcaatggcaacatttttcactgggtttatagtaggatttacacgtggttggaagctaacccttgtgattttggccatcagtcctgttcttggactgtcagctgctgtctgggcaaagatactatcttcatttacagaactcttagcgtatgcaaaagctggagcagtagcaactgtgattgcatttggaggacaaaagaaagaactaaggtacaacaaaaatttagaagaagcaagaattgggataaagaaagctattacagccaatatttctataggtgctgctttcctgctgatctatgcatcttatgctctggccttctggtatgggaccaccttggtcctctcaggggaatattctattggacaagtactcactgtattcttttctgtattaattggggctttagcatttgcaaatgcaagaggagcagcttacagctattcgaagagtgggcacaaaccagagggaaatttggaattcagaaatgttcacttcagttacccatctcgaaaagaagtgatcttgaagggcctgaacctgaaggtgcagagtgggcagacggtggccctggttggaaacagtggctgtgggaagagcacaacagtccagctgatgcagaggctctagaccataaatgtaaggtttctacgggaaatcattggtgtggtgagtcaggaacctgtattgtttgccaccacgatagcgaaagctgtcaaggaagccaatgcctacaccctggttggagagagaggggcccagttgagtggtgggcagaagcagaggatcgccattgcacgtgccctggttcgcaaccccaagatcctcctgctggaggccacgtcagccttggacacagaaagcgaagcagtggttcaggtggctctggaggccagaaaaggtcggaccaccattgtgatagctcatcgtttgtctacagttcgtggagtcattgtggagaaaggaaatcaactcatgaaagagaaaggcatttacttcaaacttgtcacaatgcagacagcaggaaattcaagatccagtctaataagaaaaagatcaactcggagtgtccgtggatcacaagcccaagacagaaagcttaccaaagaggctctggaaagtatacctccagtttccttttggaggattatgaagctaaatttaacatggccttattttgttgttggtgtattttgtgccattataaatggaggcctgcaaccagcatttgcaataatattttcaaagattataggggtttttacaagaatcttgttttcactattgtttctagcccttggaattatttcttttattacatttttccttcagggtttcacatttggcaaagctggagagatcctcaccaagcggctccgatacatggttttccgatccatgctcagacaggatgtgagttggttaaacaccactggagcattgactaccaggctcgccaaaggggctataggttccaggcttgctgtaattacccagaatatagcaaatcttgggacaggaataattatatccttcatctatggttggcaactaacactgttactcttagcaattgtacccatcattgcaatagcaggagttgtaatgaaaatgttgtctggacaagcactgaaagagaaagaactagaaggtgctgggaagatcgctacagcaatagaaaacttccgaaccgttgtttctttgactcaggagcagaagttacatatgtatgctcagagtttgcaggtaccatacagaaactctttgaggaaagcacacatctttggaattacattttccttcacccaggcaatgatgtatttttcctatgctggatgtttccggtttggagcctacttggtggcacaggatgttctgttagtattttcagctgttgtctttggtgccatggccgtggggcaagtcagttcatttgctccctatgccaaagccaaaatatcagcagcccacatcatcatgatcatcagctacagcacggaaggcctaatgccgaacacattggaaggaaatgtcacatttggagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttggcaaagaaataaagcgactgaatgttcagtggctccgagcacacctgggcatcgtgtcccaggagcccatcctgttgaacattgcctatggagacaacagccgggtggtgtcacaggaagagatcgtgagggcagcaaaggaggccaacatacatgccttcatcgagtcactgccagtaggagacaaaggaactcagctctctggtggccagaaacaacgcattgccatagctcgtgcccttgtagccacgtcagctctggatacagaaagaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgtga

SEQ ID NO: 397 - protein, 18 aa, Homo sapiens
WILKGTAMEEQRRRTFLN

SEQ ID NO: 398 - protein, 41 aa, Homo sapiens
MPIITVELVLGCWLLLTFRFHFGAWQLEDKYTKLENSFFML

SEQ ID NO: 399 - protein, 41 aa, Homo sapiens
MCTMLGSLTPDLQMMSLRLMKLLVTKLECSFSQWQHFSLGL

SEQ ID NO: 400 - protein, 32 aa, Homo sapiens
MHLMLWPSGMGPPWSSQGNILLDKYSLYSFLY

SEQ ID NO: 401 - protein, 11 aa, Homo sapiens
MQEEQLMKSSR

SEQ ID NO: 402 - protein, 14 aa, Homo sapiens
MFTSVTHLEKKLRS

SEQ ID NO: 403 - protein, 17 aa, Homo sapiens
MTPQRGWSVLMDRILGP

SEQ ID NO: 404 - protein, 24 aa, Homo sapiens
MAVKMSPWMRLRKLSRKPMPMTLS

SEQ ID NO: 405 - protein, 29 aa, Homo sapiens
MRPRQPWTQKAKQWFRWLWIRPEKVGPPL

SEQ ID NO: 406 - protein, 22 aa, Homo sapiens
MLTSSLVSMMESLWRKEIMMNS

SEQ ID NO: 407 - protein, 23 aa, Homo sapiens
MQLMNPKVKLMPWKCLQMIQDPV

SEQ ID NO: 408 - protein, 12 aa, Homo sapiens
MKVYLQFPFGGL

SEQ ID NO: 409 - protein, 35 aa, Homo sapiens
MALFCCWCILCHYKWRPATSICNNIFKDYRGFYKN

SEQ ID NO: 410 - protein, 9 aa, Homo sapiens
MEACNQHLQ

SEQ ID NO: 411 - protein, 17 aa, Homo sapiens
MILKQNDRIVTCFHYCF

SEQ ID NO: 412 - protein, 9 aa, Homo sapiens
MTLKTPLEH

SEQ ID NO: 413 - protein, 9 aa, Homo sapiens
MMLLKLKGL

SEQ ID NO: 414 - protein, 12 aa, Homo sapiens
MLRVCRYHTETL

SEQ ID NO: 415 - protein, 16 aa, Homo sapiens
MLDVSGLEPTWWHINS

SEQ ID NO: 416 - protein, 11 aa, Homo sapiens
MFPVWSLLGGT

SEQ ID NO: 417 - protein, 12 aa, Homo sapiens
MPKPKYQQPTSS

SEQ ID NO: 418 - protein, 22 aa, Homo sapiens
MSHLVKLYSTIPPDRTSQCFRD

SEQ ID NO: 419 - protein, 41 aa, Homo sapiens
MFSGSEHTWASCPRSPSCLTAALLRTLPMETTAGWCHRKRS

SEQ ID NO: 420 - protein, 14 aa, Homo sapiens
MPSSSHCLINIALK

SEQ ID NO: 421 - protein, 29 aa, Homo sapiens
MKPRQLWIQKVKRLSKKPWTKPEKAAPAL

SEQ ID NO: 422 - protein, 33 aa, Homo sapiens
MAESRSMARISSCWHRKASIFQWSVSRLEQSAS

SEQ ID NO: 423 - protein, 609 aa, Homo sapiens
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 424 - DNA, 2032 bp, Homo sapiens
tccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaactttccaagccataactgttactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacgatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatg

SEQ ID NO: 425 - protein, 508 aa, Homo sapiens [sequence omitted]

SEQ ID NO: 426 - DNA, 1527 bp, Homo sapiens
atgattttactgaatccagaacactgcatagaaatgaatatggaacttccatattggattcttaccaatgtactgcagagactgacctggctaccatattttttgcccagtttgttcaagaagccacttacaaggaagctgcaattgagaaacccactggagatgaacagtcttcagggtgttaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcacaagaaggcatcccttcctgtatgcacctacaattcttctttgggctgctcgctatgacaaaattccatcttgctgcaaagctgaaaatgcagttgaatgcttccaaacaaaggcagcaacagttacaaaagaataaaattttgggacccgaactttccaagccagtcagaagtttaccaaagttaattttactgaaatccagaaactcctggatgtggcccatgtacatgagcactgttgcagaggagatgtgctggattgtctgcaggatggggaaaaaatcatgtcctacatatgttctcaacaagacactctgtcaaacaaaaccacgctggaacgtggtcaatgtattcatgcagaaaatgatgaaaaacctgaaggtctatctccaaatcgagatagagattttaaccaattttcttcaggggaaaaaaatatcttcttggcaagttttgttcatgaatattcaagaagacatcctcagcttgctgtctcaggagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaacgagaatattacttacaaaatgcgtttctcgttgcttacacaaagaaagccccccagctggccatcaccagaaaaatggcagccacagcagccacttgttgccaactcagtgaggacaaactattggcctgtggcgagggagcggctgacattattatcggacacttatgtatcagacatgaaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgagcaaaagccacaaacagaggaacaacttgaggctgtcattgcagatttctcaggcctgttggagaaatgctgccaaggccaggaacaggaagtctgctttgctgaagagggacaaaaactttcaaaaactcgtgctgctttgggagttttga

SEQ ID NO: 427 - protein, 520 aa, Homo sapiens [sequence omitted]

SEQ ID NO: 428 - DNA, 1563 bp, Homo sapiens
atggaagtgggtggaatcaatttttttaattttcctactaaattttacatatggaatagcttccatattggattcttaccaatgtactgcagagataagtttagccctggctaccatattttttgcccagtttgttcaagaagccacttacaaggaagtaagcaaaatggtgaaagatgcattgactgcaatacagtcttcagggtgtttagaaaaccagctacctgcctttctggaagaactttgccagaaagaaattttggagaagtacggacattcagactgctgcagccaaagctgttttcttgcacacaaaaagcccactccagcatcgatcccacttttccaagttccagaacctgtcacaagctgagcataagaagacagggagacattcatgaacaaattcatttagatagcaagaaggcatcccttcctgtatgcacctacaattcttctttgggctgctcgctacaaaataattccatcttgctgcaaagcatgcttccaaacaaaggcagcaacagttacaaaagaattaagagaaagcagcttgttaaatcaacatgcatgtgcagtaatgaaaaattttgggacccgaactttccaagccataactgttacaatccagaaactagtcctggatgtggcccatgtacagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaaaggtctatctccaaatctaaacaggtttttaggagaccaattttcttcaggggaaaaaaatatcttcttggcaagttttgttcaatattcaagaagacatcctcagcttgctgtctcagtaattctaagagttgcaggataccaggagttattggagaagtgtttccagacaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagggacaaactattggcctgtggcgagggagcggccattattatcggacacttatgtatcagacaaatgactccagtaaaccctggtgttggccagtgctgcacttcttcatatgccaacaggaggccatgcttcagcagcttggtggtggaggatctgtgccaagctcagggtgtagcgctgcaaacgatgaagcaagagtttctcatccttgtgaagcaaaagccacaaataacagaggaacaactggctgtcattgcagatttctcaggcctgttggagaaatgctgccaaggccaggaacaggaagtctgctttgcagagggacaaaaactgatttcaaaaactcgtgctgctttgggagtttatga

SEQ ID NO: 429 - protein, 15 aa, Homo sapiens
EVGGINFFNFPTKFY

SEQ ID NO: 430 - protein, 59 aa, Homo sapiens
MRKKFWRSTDIQTAAAKVKREDITVFLHTKSPLQHRSHFSKFQNLSQAVKHMKKTGRHS

SEQ ID NO: 431 - protein, 14 aa, Homo sapiens
MHLQFFFGLLAMTK

SEQ ID NO: 432 - protein, 16 aa, Homo sapiens
MQLNASKQRQQQLQKN

SEQ ID NO: 433 - protein, 41 aa, Homo sapiens
MLPNKGSNSYKRIKRKQLVKSTCMCSNEKFWDPNFPSHNCY

SEQ ID NO: 434 - protein, 38 aa, Homo sapiens
MWPMYMSTVAEEMCWIVCRMGKKSCPTYVLNKTLCQTK

SEQ ID NO: 435 - protein, 31 aa, Homo sapiens
MFSTRHSVKQNNRMLQTDHAGTWSMYNSCRK

SEQ ID NO: 436 - protein, 14 aa, Homo sapiens
MQKMMKNLKVYLQI

SEQ ID NO: 437 - protein, 13 aa, Homo sapiens
MNIQEDILSLLSQ

SEQ ID NO: 438 - protein, 13 aa, Homo sapiens
MRFSLLTQRKPPS

SEQ ID NO: 439 - protein, 38 aa, Homo sapiens
MPTGGHASAAWWWMKHMSLLHSLMTSSFSIRICAKLRV

SEQ ID NO: 440 - protein, 252 aa, Homo sapiens [sequence omitted]

SEQ ID NO: 441 - DNA, 759 bp, Homo sapiens
atgacaccgggcacccagtctcctttcttcctgctgctgctcctcacagtgcttacaggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacatggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtag

SEQ ID NO: 442 - protein, 242 aa, Homo sapiens [sequence omitted]

SEQ ID NO: 443 - DNA, 729 bp, Homo sapiens
atgcaccgggcacccagtctcctttcttcctgctgctgctcctcacagtgcttacaggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcaggccaggatctgtggtggtacaatctctggccttccgagaaggtaccatcaatgtccacgacatggagacacagttcaatcagtataaaacggaagcagcctctcgatataaccgtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgttga

SEQ ID NO: 444 - protein, 213 aa, Homo sapiens [sequence omitted]

SEQ ID NO: 445 - DNA, 642 bp, Homo sapiens
atggacaccgggcacccagtctcctttcttcctgctgctgctcctcacagtgcttacaggttctggtcatgcaagctctaccccaggtggagaaaaggagacttcggctacccagagaagttcagtgcccagctctacttcctctctggaagatcccagcaccgactactaccaagagctgcagagagacatttcacaagggggttttctgggcctctccaatatgttcaggccaggatctgtggtggtacaattgactctggccttccgagaaggtaccatcaatgtccacgacatggagacacagttcaatcagtacctgacgatctcagacgtcagcgtgagtgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctggtggcagcagcctctcttacacaaacccagcagtggcagccacttctgccaacttgtatga

SEQ ID NO: 446 - protein, 45 aa, Homo sapiens
DTGHPVSFLPAAAPHSAYRFWSCKLYPRWRKGDFGYPEKFSAQLY

SEQ ID NO: 447 - protein, 98 aa, Homo sapiens
HRAPSLLSSCCCSSQCLQVLVMQALPQVEKRRLRLPREVQCPALLRRMLLIPLWKIPAPTTTKSCRETFLKCFCRFINKGVFWASPILSSGQDLWWYN

SEQ ID NO: 448 - protein, 21 aa, Homo sapiens
MSTTWRHSSISIKRKQPLDIT

SEQ ID NO: 449 - protein, 63 aa, Homo sapiens
MCHFLSLPSLGLGCQAGASRCWCWSVFWLRWPLSISLPWLSVSAAERTTGSWTSFQPGIPTIL

SEQ ID NO: 450 - protein, 41 aa, Homo sapiens
MGAMCPLAVPIVAPMRRFLQVMVAAASLTQTQQWQPLLPTC

SEQ ID NO: 451 - protein, 509 aa, Homo sapiens
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKRKKNVLRLCCKKLKIFAMPMQDIKMILKMVQLDSIEDLEVTCTWKLPTLAKFSPYLGQMINLRRLLLSHIHASSYISPEKEEQYIAQFTSQFLSLQCLQALYVDSLFFLRGRLDQLLRHVMNPLETLSITNCRLSEGDVMHLSQSPSVSQLSVLSLSGVMLTDVSPEPLQALLERASATLQDLVFDECGITDDQLLALLPSLSHCSQLTTLSFYGNSISISALQSLLQHLIGLSNLTHVLYPVPLESYEDIHGTLHLERLAYLHARLRELLCELGRPSMVWLSANPCPHCGDRTFYDPEPILCPCFMPN

SEQ ID NO: 452 - DNA, 2148 bp, Homo sapiens
gcttcagggtacagctcccccgcagccagaagccgggcctgcagcccctcagcaccgctccgggacaccccacccgcttcccaggcgtgacctgtcaacagcaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagcaaaaaaaaaaaaaaaaaa

SEQ ID NO: 453 - protein, 444 aa, Homo sapiens [sequence omitted]

SEQ ID NO: 454 - DNA, 1335 bp, Homo sapiens
atgtggaacgaaggcgtttgtggggttccattcagagccgatacatcagcagtgtgtggacaagcccacggagacttgtggagctggcagggcagagcctgcaggatgaggccctggccattgccgccctggagttgctgcccagggagctcttcccgccactcttcatggcagcctttgacgggagacacagccagacccaggcaatggtgcaggcctggcccttcacctgcctccctctgggagtgcagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccagcacagaggcagagcagcccttcattccagacctgttcctcaaggaaggtgcctgtgatgaattgttctcctacctcattgagaaagagcgaaagaaaaatgtactacgcctgtgctgtaagaagcagatttttgcaatgcccatgcaggatatcaagaaaatggtgcagctggactctattgaagatttggaagcttgtacctggaagctacccaccttggcgaaattttctccttacctgggccagattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgctaactgccggctttcggaaggggatgtgcatctgtcccagagtcccagcgtcagtcagcgtcccgagcccctccaagctctgctggagagagcctctgccaccctccaggacctggtctttgatgagtgtgggatcacggatgatcagctccttgccctcctgccttcccgcttctacgggaattccatctccatatctgccttgcagagtctcctgcagcacctcatcgggccccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaacttga

SEQ ID NO: 455 - protein, 473 aa, Homo sapiens [sequence omitted]

SEQ ID NO: 456 - DNA, 1422 bp, Homo sapiens
atgggaacgaaggcgtttgtggggttccattcagagccgatacatcagcatgagtgtgtggacaagcccacggagacttgtggagctggcagggcagagcctgctgaaggaggccctggccattgccgccctggagttgctgcccagggagctcttcccgccactcttcatggcagccttcgggagacacagccagaccctgaaggcaatggtgcaggcctggcccttcacctgcctccctctgggagtgctgatgaagggacaacatcttcacctggagaccttcaaagctgtgcttgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctggaaagtgaagcgaaagaaaaatgtactacgcctgtgctggaagctgaagatttttgcaatgcccatgcaggatatcaagatgatcctgaaaatggtgcagctggactctatagatttggaagtgacttgtacctggaagctacccaccttggcgaaattttctccttacctgggccagatgatactcctcctctcccacatccatgcatcttcctacatttccccggagaaggaagagcagtatatcgcccagttcacctctcagttcctcagtctgcagtgcctgcaggctctctatgtggactctttatttttcctaggccgcctggatcagttgctcaggcacgtgatgaaccccttggaaaccctctcaataacctgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttaggacatccatggtaccctccacctggagaggcttgcctatctgcatgccaggctcagggagttgctgtggttggggcggcccagcatggtctggcttgccaacccctgtcctcactgtggggacagaaccttctacccggagcccatcctgtgcccctgtttcatgcctga

SEQ ID NO: 457 - protein, 16 aa, Homo sapiens
WNEGVCGVPFRADTSA

SEQ ID NO: 458 - protein, 36 aa, Homo sapiens
GTKAFVGFHSEPIHQHECVDKPTETCGAGRAEPAEG

SEQ ID NO: 459 - protein, 32 aa, Homo sapiens
MRPWPLPPWSCCPGSSSRHSSWQPLTGDTARP

SEQ ID NO: 460 - protein, 53 aa, Homo sapiens
MDLMCSLPRRFAPGGGNFKCWIYGRTLIRTSGLYGLETGPVCTHFQSQKQLSP

SEQ ID NO: 461 - protein, 53 aa, Homo sapiens
MVWKQGQSVLISRARSSSAHDKEAKSRWFEHRGRAALHSSRGARRPVPQGRCL

SEQ ID NO: 462 - protein, 10 aa, Homo sapiens
MNCSPTSLRK

SEQ ID NO: 463 - protein, 9 aa, Homo sapiens
MYYACAVRS

SEQ ID NO: 464 - protein, 49 aa, Homo sapiens
MHLPTFPRRRKSSISPSSPLSSSVCSACRLSMWTLYFSLEAAWISCSGT

SEQ ID NO: 465 - protein, 16 aa, Homo sapiens
MSVGSRMISSLPSCLP

SEQ ID NO: 466 - protein, 62 aa, Homo sapiens
MRTSMVPSTWRGLPICMPGSGSCCVSWGGPAWSGLVPTPVLTVGTEPSMTRSPSCAPVSCLT

SEQ ID NO: 467 - protein, 983 aa, Homo sapiens
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDVWSYGIVLWEVMSYGERPYWEMSNQDVIKAVDEGYRLPPPMDCPAALYQLMLDCWQKDRNNRPKFEQIVSILDKLIRNPGSLKIITSAAARPSNLLLDQSNVDITTFRTTGDWLNGVWTAHCKEIFTGVEYSSCDTIAKISTDDMKKVGVTVVGPQKKIISSIKALETQSKNGPVPV

SEQ ID NO: 468 - DNA, 5799 bp, Homo sapiens
cccgctctgcttcagcgcacgctgaagacggcactaggacccagggaagtccccgagcggggttcgcggaaaggcagccagactcctccttatctccagtgtcaaacttgacatcagcctgcgagcggagcatggtaacttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctgctccatcacctgtcctgacgattaagaaagatcggacctccagaaatagcatctctttgtcctggcaagaacctgaacatcctaatgggatcatattggactacgaggtcaaatactatgaaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactctttctccatctctggtgaaagtagccaagtggtcatgatcgccatttcagcggcagtagcaattattctcctcactgttgtcatctatgttttgattgggaggttctgtggctataagtcaaaacatggggcagatgaaaaaagacttcattttggcaatgggcatttaaaacttccaggtctcaggacttatgttgacccacatacatatgaagaccctacccaagctgttcatgagtttgccaaggaattggatgccaccaacatatccattgataaagttgttggagcaggtgaatttggagaggtgtgcagtggtcgcttaaaacttccttcaaaaaaagagatttcagtggccattaagaccctgaaagttggctacacagaaaagcagaggagagacttcctgggagaagcaagcattatgggacagtttgaccaccccaatatcattcgactggaaggagttgttaccaaaagtaagccagttatgattgtcacagaatacatggagaatggttccttggatagtttcctacgtaaacacgatgcccagtttactgtcattcagctagtggggatgcttcgagggatagcatctggcatgaagtacctgtcagacatgggctatgttcaccgagacctcgctgctcggaacatcttgatcaacagtaacttggtgtgtaaggtttctgatttcggactttcgcgtgtcctggaggatgacccagaagctgcttatacaacaagaggagggaagatcccaatcaggtggacatcaccagaagctatagcctaccgcaagttcacgtcagccagcgatgtatggagttatgggattgttctctgggaggtgatgtcttatggagagagaccatactgggagatgtccaatcaggatgtaattaaagctgtagatgagggctatcgactgccaccccccatggactgcccagctgccttgtatcagctgatgctggactgctggcagaaagacaggaacaacagacccaagtttgagcagattgttagtattctggacaagcttatccggaatcccggcagcctgaagatcatcaccagtgcagccgcaaggccatcaaaccttcttctggaccaaagcaatgtggatatcactaccttccgcacaacaggtgactggcttaatggtgtctggacagcacactgcaaggaaatcttcacgggtgtggagtacagttcttgtgacacaatagccaagatttccacagatgacatgaaaaaggttggtgtcaccgtggttgggccacagaagaagatcatcagtagcattaaagctctagaaacgcaatcaaagaatggcccagttcccgtgtaaagcacgggacggaagtgcttctggacggaagtggtggctgtggaaggcgtagcatcatcctgcagacagacaataattctggagatactggtggaagttccaagtccaataagacactcaaatatgagtacaaatgccttaaaatggaattgaaaaactctttattttcccctatcatttattggatgggtgggtggggtatttttttgtaattgcttttttaaatattagttaatggattaaatttaattcttcagcgtaaaatggtgaagaactagcatatagccattgatcataaactgactatcataaaatcaaaacaagtgaaataacaaaatggacatggtggctttgtttaggtagagccacaaaagaaaagacttgtaatatttttatatacagaggaaatctgtaacaggtattttgtttcttttaaagcaagcaacacagaggaatttatacctcaaactatctggccatatttactaccttatcactgcattattctcttttatctgtttaaagcatatagagatgaagtttgtagttgttttaagtactacacatttttaaattgttagcttccttaagtatatcatgtaaagaaatgtcttaatttttgaaaaaagtacatatttattttcttttgaattgtttttattgttttctatttatgccttgatgatttaatatggatttgttacagccaagtgccaaatgctctctcaaattgtcagcaatttaactagacacagataataatgggtttctttcagattttttgaaccatccacttacatatatttttaaaaaatgaaatccttttcctgttcatacactaaccaaatctctcaaatctgttatcccaatcattgttgcctctccgtttattataaactgtatgctcacaacttagtgtaatataccagcttgtatgcaatggattttcaaccagataacatacctttcctgctctggtgcttagagactatcaactccctcctttagtgaaggagccgtgttagagcttccgagaatagctccactggagagaagtggaatcctatatagaatgctgcactaattgacaacacagcctataggccaatgcatgagtaaaaaaaaaaacaattactggctcactggctttgaaaagtcacttactattgttgctgaaacttgctgagctgtttatagagaatgatgataacagaacttttcctctgtatcactggtgtttaggtgaattaattaaacattgtgatcattagtaccaggtattattatctttaagagtcttccacttcaatgcacatggtgcagttttggtgtgtaacttagaaggattgaacttctttgaatttactggacataacattttcagaatagttggtcatctagcaaccgcctcaaaatgtgtaagcaggagagaaatttctcatcacagggatttagacttactattacataaaggctaactatgagcttgctcattaattttgaaaagatgtacctggtggatatctagctagtaatatattctgaagcaacattttagctctattgatactctttctaatgctgatatgatcttgagtataagaaatgcatatgtcactagaatggataaaataatgctgcaaacttaatgttcttatgcaaaatggaacgctaatgaaacacagcttacaatcgcaaatcaaaactcacaagtgctcatctgttgtagatttagtgtaataagacttagattgtgctccttcggatatgattgtttctcaaatcttggcaatattccttagtcaaatcaggctactagaattctgtattggatatataagagcatgaaatttttaaaaatacacttgtgattataaaattaatcacaaatttcacttatacctgctatcagcagctagaaaacattttttttttaaatcaagtattttgtgtttggaatgttagaatgagatctgaatgtggtttcaatctaattttttcccagactactatttctttttaggtattattctgagcatactcaacaaaacccatgcatttcataaactaatagaagttgaggattgttgaatctatttcacttattttggctgtggtttccatctgaaagtagaggttgtatacaccatatactgttcttcattttattaatatttttctccttgacctctcataaatttactttacacaattcttaccctgtacatatgtaaacataagtgtacgattcttaaccatggagtagaggtactagaatgcttacggccatctctttgtacaggaactgcattgactttcagtaaacataaagccacaactcctacatgatgttatgtaccatatgatctgttttgtatcttaaatttgatttacatatattatttatttctggtaactcactcagtttatgctgtgctaaatatcaatcaagccatgtataaatgtgatatgattggcaatatgtgtttatgttgtacaatgtaaatggcctcttactaatgtaaaatgatttgtagtggaaacatttatatttttataataaacataatgaaaatattttttacagattggaaaaaaaaaaaaaaaaaaaaaaaaaaaaaa

SEQ ID NO: 469 - protein, 930 aa, Homo sapiens [sequence omitted]

SEQ ID NO: 470 - DNA, 2793 bp, Homo sapiens
atgtggattgtcagctctccatcctcctccttctcagctgctctgttctcgacagcttcggggaacttccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggcgaacaaactgggtccccaggaactcagctcagaagatttatgtggagctcaagttcactctacgagactgcaatagcattccattggtttgaacttgcaaggagacattcaacctgtactacatggagtctgatgatgatcatggggaatttcgagagcatcagtttacaaagattgacaccattgcagctgatgaaagtttcactcaaatggatcttggggaccgtattcagctcaacactgagattagagaaggtcctgtcaacaagaagggattttatttggcatttcaagatgttggtgcttgtgttgccttggtgtctggagtatacttcaaaaagtgcccatttacagagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaagcttgtcgaccaggtttctacaaggcattggatggtaataagtgtgctaagtgcccgcctcacagttctactcaggaagatggttcaaactgcaggtgtgagaataattacttccgggcagacaaagaccctccatccatggcttgtacccgacctccatcttcaccaagaaatgttatctctaataacgagacctcagttatcctggactggagttggcccctggacacaggaggccggaaagatgttaccttcaacatcatatgtaaaaaatgtgggtggaataaacagtgtgagccatgcagcccaaatgtccgcttcctccctcgacagtttggactcaccaacaccacggcagaccttctggcacatactaactacacctttgagattgatgccgttaatggggtgtcagagcgctccccaccaagacagtttgctgcggtcagcatcacaactaatcaggctgctccatcacctgtcccgattaagaaagatcggacctccagaaatagcatctctttgtcctggcaagaacctgaacatcctaatgggatcatattggactacgaggtcaaatactatgaaaagcaggaacaagaaacaagttataccattcgggcaagaggcacaaatgttaccatcagtagcctcaagcctgacactatatacgtattccaaatccgagcccgaacagccgctggatatgggacgaacagccgcaagtttgagtttgaaactagtccagactctttctccatctctggtgaaagtagccaagtggtcatcgccatttcagcggcagcaattattctcctcactgttgtcatctatgtttttgggaggttctgtggctataagtcaaaacatggggcagatgaaaaaagacttcattttggcaatgggcattaacttccaggtctcaggacttatgttgacccacatacatatgaagaccctacccaagctgttcatgagtttgccaaggaattggatgccaccaacatatccattgataaagttgttggagcaggtgaatttggagaggtgtgcagtggtcgctaacttccttcaaaaaaagagatttcagtggccattaagacccaagttggctacacagaaaagcagaggagagacttcctgggagaagcaagcattatgggacagtttgaccaccccaatatcattcgactggaaggagttgttaccaaaagtaagccagttattgtcacagaatacatggagaatggttccttggatagtttcctacgtaaacacgatgcccagtttactgtcattcagcagtacctgtcagacatgggctatgttcaccgagacctcgctgctcggaacatcttcaacagtaacttggtgtgtaaggtttctgatttcggactttcgcgtgtcctggaggatgacccagaagctgcttatacaacaagaggagggaagatcccaatcaggtggacatcaccagaagctacctaccgcaagttcacgtcagccagcgatgtatggagttatgggattgttctctgggaggtgtcttatggagagagaccatactgggagatgtccaatcaggatgttaaagctgatgagggctatcgactgccaccccccatggactgcccagctgccttgtatcagctgctggactgctggcagaaagacaggaacaacagacccaagtttgagcagattgttagtattctggacaagcttatccggaatcccggcagccagatcatcaccagtgcagccgcaaggccatcaaaccttcttctggaccaaagcaatgtggatatcactaccttccgcacaacaggtgactggcttaatggtgtctggacagcacactgcaaggaaatcttcacgggtgtggagtacagttcttgtgacacaaaaaaggttggtgtcaccgtggttgggccacagaagaagatcatcagtagcattaaagctcaaacgcaatcaaagaatggcccagttcccgtgttga

SEQ ID NO: 471 - protein, 818 aa, Homo sapiens [sequence omitted]

SEQ ID NO: 472 - DNA, 2457 bp, Homo sapiens
atgggattgtcagctctccatcctcctccttctcagctgctctgttctcgacagcttcggggaactgattccgcagccttccaaagtcaatctactggattcaaaaacaattcaaggggagctgggctggatctcttatccatcacatgggtgggaagagatcagtggtgtggaacattacacacccatcaggacttaccaggtgtgcaatgtcatggaccacagtcaaaacaattggctgagaacaaactgggtccccaggaactcagctcagaagatttatgtggagctcaagttcactctacgagactgcaacattccattggttttaggaacttgcaaggagacattcaacctgtactacatggagtctcatggggtgaaatttcgagagcatcagtttacaaagataagtttcactcaaatggatcttggggaccgtattctgaagctcaacacagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggtggaggaagatcctccaaggatgtactgcagtacagaaggcgaatggcttgtacccattggcaagtgttcctgcaatgctggctaagaaagaggttttatgtgccaagcttgtcgaccaggtttctacaaggcattggatgggtgcccgcctcacagttctactcaggaagatggttcaatgaactgcaggtgttacttccgggcagacaaagaccctccatccatggcttgtacccgacctccatcttcaccaagaaatgttatctctataaacgagacctcagttatcctggactggagttggcccctggacacaggaggccggaaagatgttaccttcaacatcatatgaaaatgtgggtggaatataaaacagtggccatgcagcccaaatgtccgcttcctccctcgacagtttggactcaccaacaccacggtgacagtgacagaccttctggcacatactggggtgtcagagctgagctccccaccaagacagtttgctgcggtcagcatcacaactcaggctgctccatcacctgtcctgacgattgggatcatattggactacgaggtcaaatactaaaagcaggaacaagaaacaagttataccattctgagggcaagaggcacaaatgttaccatcagcactatatacgtattccaaatccgagcccgaacagccgctggatatgggacgaacagccgcaagttccaagtggtcatgatcgccatttcagcggcagtagcaattattctcctcactgttgtcatctatgttttgattgggaggttctgtggctaaaaaagacttcattttggcaatgggcatttaaaacttccaggtctcaggacttatgtgtttgccaaggaattggatgccaccaacatatccatatttggagaggtgtgcagtggtcgcttaaaacttccttcaaaaaaagagatttcagtggccatgaccctgaaagttggctacacagaaaagcagaggagagacttcctgggagaagcaagcattatgggacagttccaccccaatatcattcgactggaaggagttgttaccaaaaggccagttatgattgtcacagaatacatggagaatggttccttggaacacgatgcccagtttactgtcattcagctagtggggatgcttcgagggatagcatctggcatgaagtacctgtcagacatgggctatgttcaccgagacctcgctgctcggaacatcttgatcaacagtttcggactttcgcgtgtcctggaggacccagaagctgcttatacaacaagaggagggaagatcccaatcaggtggacatcaccagaagctatagcctaccgcaagttcacgtcagccagcgatgtatggagttatgggattgttctctgggaggtgatgtcttatggagagagaccatactgggagatgtccaatcaggatgtaatgggctatcgactgccaccccccatggactgcccagctgccttgtatcagctgatgctggactgctggcagaaagacaggaacaacagacccaagtttattctggacaagcttatccggaatcccggcagcctgaagatcatcaccagtgcagccgcaaggccatcaaaccttcttctggaccaaagcaatgtggatatcactaccttccgcacaacaggtggtgtctggacagcacactgcaaggaaatcttcacgggtgtggagtacagttcttgcatgaaaaaggttggtgtcaccgtggttgggccacagaagaagatcatcagagctctagaaacgcaatcaaagaatggcccagttcccgtgtatga

SEQ ID NO: 473 - protein, 21 aa, Homo sapiens
WIVSSPSSSFSAALFSTASGN

SEQ ID NO: 474 - protein, 27 aa, Homo sapiens
GLSALHPPPSQLLCSRQLRGTDSAAFQ

SEQ ID NO: 475 - protein, 17 aa, Homo sapiens
MWSSSSLYETAIAFHWF

SEQ ID NO: 476 - protein, 13 aa, Homo sapiens
MKVSLKWILGTVF

SEQ ID NO: 477 - protein, 10 aa, Homo sapiens
MLVLVLPWCL

SEQ ID NO: 478 - protein, 14 aa, Homo sapiens
MACTHWQVFLQCWL

SEQ ID NO: 479 - protein, 25 aa, Homo sapiens
MLAMKKEVLCAKLVDQVSTRHWMVI

SEQ ID NO: 480 - protein, 14 aa, Homo sapiens
MLPSTSYVKNVGGI

SEQ ID NO: 481 - protein, 28 aa, Homo sapiens
MQPKCPLPPSTVWTHQHHGDSDRPSGTY

SEQ ID NO: 482 - protein, 15 aa, Homo sapiens
MSASSLDSLDSPTPR

SEQ ID NO: 483 - protein, 23 aa, Homo sapiens
MGSYWTTRSNTMKSRNKKQVIPF

SEQ ID NO: 484 - protein, 51 aa, Homo sapiens [sequence omitted]

SEQ ID NO: 485 - protein, 14 aa, Homo sapiens
MGQMKKDFILAMGI

SEQ ID NO: 486 - protein, 44 aa, Homo sapiens
MLTHIHMKTLPKLFMSLPRNWMPPTYPLIKLLEQVNLERCAVVA

SEQ ID NO: 487 - protein, 19 aa, Homo sapiens
MVPWIVSYVNTMPSLLSFS

SEQ ID NO: 488 - protein, 11 aa, Homo sapiens
MFTETSLLGTS

SEQ ID NO: 489 - protein, 23 aa, Homo sapiens
MTQKLLIQQEEGRSQSGGHHQKL

SEQ ID NO: 490 - protein, 11 aa, Homo sapiens
MYGVMGLFSGR

SEQ ID NO: 491 - protein, 27 aa, Homo sapiens
MELWDCSLGGDVLWRETILGDVQSGCN

SEQ ID NO: 492 - protein, 13 aa, Homo sapiens
MERDHTGRCPIRM

SEQ ID NO: 493 - protein, 18 aa, Homo sapiens
MRAIDCHPPWTAQLPCIS

SEQ ID NO: 494 - protein, 36 aa, Homo sapiens
MWISLPSAQQVTGLMVSGQHTARKSSRVWSTVLVTQ

SEQ ID NO: 495 - protein, 163 aa, Homo sapiens
MADEEKLPPGWEKRMSRSSGRVYYFNHITNASQWERPSGNSSSGGKNGQGEPARVRCSHLLVKHSQSRRPSSWRQEKITRTKEEALELINGYIQKIKSGEEDFESLASQFSDCSSAKARGDLGAFSRGQMQKPFEDASFALRTGEMSGPVFTDSGIHIILRTE

SEQ ID NO: 496 - DNA, 994 bp, Homo sapiens
tgctggccagcacctcgagggaagatggcggacgaggagaagctgccgcccggctgggagaagcgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcagccatgggccctctgagcaactgtgcagaccctttcacccccaattaaacccagaacca

SEQ ID NO: 497 - protein, 160 aa, Homo sapiens
MWRTRRSCRPAGRSAAAAQAECTTSTTSLTPASGSGPAATAAVVAKTGRGSLPGSAARTCWSTASHGGPRPGGRRRSPGPRRRPWSSTATSRRSSRERRTLSLWPHSSATAAQPRPGETWVPSAEVRCRSHLKTPRLRCGRGRAGPCSRIPASTSSSALS

SEQ ID NO: 498 - DNA, 483 bp, Homo sapiens
atgtggcggacgaggagaagctgccgcccggctgggagaagcgcagccgcagctcaggccgagtgtactacttcaaccacatcactaacgccagccagtgggagcggcccagcggcaacagcagcagtggtggcaaaaacgggcagggggagcctgccagggtccgctgctcgcacctgctggagcacagccagtcacggcggccctcgtcctggcggcaggagaagatcacccggaccaaggaggaggccctggagctcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagagcgggcccgtgttcacggattccggcatccacatcatcctccgcactgagttga

SEQ ID NO: 499 - protein, 159 aa, Homo sapiens [sequence omitted]

SEQ ID NO: 500 - DNA, 480 bp, Homo sapiens
atgggcggacgaggagaagctgccgcccggctgggagaagcgcatgagccgcagctcaggccgagtgtactacttcaaccacatcaccgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggacttgtctctggcctcacagttcagcgactgcagctcagccaaggccaggggagacctgggtgccttcagcagaggtcagatgcagaagccattagacgcctcgtttgcgctgcggacgggggagatgagcgggcccgtgttcacggattccggcatccacatcatcctccgcactga

SEQ ID NO: 501 - protein, 15 aa, Homo sapiens
MWRTRRSCRPAGRSA

SEQ ID NO: 502 - protein, 29 aa, Homo sapiens
MGGRGEAAARLGEAHEPQLRPSVLLQPHH

SEQ ID NO: 503 - protein, 179 aa, Homo sapiens
MLNVSGLFVLLCGLLVSSSAQEVLAGVSSQLLNDLTQGLLRADFLPSLQTTGLQKPLSSAFDGVSGLLDIFGPPLTNEINTVSIQVKNPQLLHVSIESTPQRKEATVQVPFTSELIVQLLTMKPFTANMQSDIKVQIRLEKNVGGRYELAFGNCRLLPEAIWIQTGVQLAPAQNLLWQT

SEQ ID NO: 504 - DNA, 1280 bp, Homo sapiens
ggccagagtgtcttgacagcacaccagagaaatccagggacctgaccgaagatgctgaatgtctccggcctctttgttctcctctgtgggctgcttgtctcatcctctgcacaggaggtcctggctggagtttcttcccagctccttaatgatttgactcaaggactcctcagggcagactttcttcccagcctgcagacaactggcctccagaaaccattgagtagtgccttcgatggtgtatcaggcctcctggacatctttggacctccactcaccaatgagatcaacactgttagcatacaggtgaaaaatcctcaactcctccatgtctccatcgagagcacccctcaaagaaaggaggccactgtacaagtaccattcacgtctgagttgattgtgcagctcctgaccatgaagcccttcacagctaatatgcagtcagatataaaagtccagattcgtttggagaagaatgtaggtggcagatatgagcttgcctttgggaactgcaggctcttgcccgaggctatttggatccaaactggagtccaactcgccccagcgcaaaatttgttgtggcaaacatagagagaaacctgaaaaacatagtagcccatgatctgggacgaaaagtgtgccctgtgattaataaatggctctacaacctggaccagcatgtggttaaagagttgattaatctggtcctgctgcaggaaaagtaccaagtcaccatctaaatgtccccaaagtgaagaagctatgtgtgtatcaatccgaatcagcttctgcatcctagtctcctccctggaatgtcctccacactccaggacaccacctgcgtagatcgtgttgattattcagctgatgcctggaattgcatgacccaccctggaccaaaagagcccctgcttctccgggtatggaggttatttccctgtaaatcctcaccagaacccatgtgctgattccctgtaatcttcccacaataaatttttagcagctctgaactgcaaactgtccagcttccacagcgccatgtggatgggggcaacgtggccagagatgatggtgggtctggtcatgataacaaaagtatgaaaagcaggggaggatacttgggttgatttatccattatctcataaacatctgaacactctggtatgatgtttcccaaaggctaattaaaattttaaaaaggtgaaaaaaaaaaaaaaaaaaaaaaaaaaaaaaaaaaaaaaaaaaaaaaaaaaaaaaaaaaaaaaaaaaaaaaaaaaaa

SEQ ID NO: 505 - protein, 164 aa, Homo sapiens
MSPASLFSSVGCLSHPLHRRSWLEFLPSSLMILKDSSGQTFFPACRQLASRNHVVPSMVYQASWTSLDLHSPMRSTLLAYRKILNSSMSPSRAPLKERRPLYKYHSRLSSPSQLICSQIKSRFVWRRMVADMSLPLGTAGSCPRLFGSKLESNSPQRKICCGKH

SEQ ID NO: 506 - DNA, 495 bp, Homo sapiens
atgtctccggcctctttgttctcctctgtgggctgcttgtctcatcctctgcacaggaggtcctggctggagtttcttcccagctccttaatgattctcaaggactcctcagggcagactttcttcccagcctgcagacaactggcctccagaaaccatgtagtgccttcgatggtgtatcaggcctcctggacatctttggacctccactcaccaatgagatcaacactgttagcatacaggaaaatcctcaactcctccatgtctccatcgagagcacccctcaaagaaaggaggccactgtacaagtaccattcacgtctgagtagcccttcacagctaatatgcagtcagataaagtccagattcgtttggagaagaatggtggcagatatgagcttgcctttgggaactgcaggctcttgcccgaggctatttggatccaaactggagtccaactcgccccagcgcaaaatttgttgtggcaaacattga

SEQ ID NO: 507 - protein, 172 aa, Homo sapiens [sequence omitted]

SEQ ID NO: 508 - DNA, 519 bp, Homo sapiens
atggctgaatgtctccggcctctttgttctcctctgtgggctgcttgtctcatcctctgcacaggaggtcctggctggagtttcttcccagctccttttgactcaaggactcctcagggcagactttcttcccagcctgcagacaactggcctccagaaaccattgagtgccttcgatggtgtatcaggcctcctggacatctttggacctccactcaccaagatcaacactgtcatacaggtgaaaaatcctcaactcctccatgtctccatcgagagcacccctcaaagaaaggaggccactgtacaagtaccattcacgtcgttgattgtgcagctcctgaccatgaagcccttcacagctatgcagtcagatataaaagtccagattcgtttggagaagaatgtaggtggcagatagcttgcctttgggaactgcaggctcttgcccgaggctatttggatccaaactggagtccaactcgccccagcgcaaaatttgttgtggcaaacatatga

SEQ ID NO: 509 - protein, 31 aa, Homo sapiens
AECLRPLCSPLWAACLILCTGGPGWSFFPAP

SEQ ID NO: 510 - protein, 32 aa, Homo sapiens
MSPASLFSSVGCLSHPLHRRSWLEFLPSSLMI

SEQ ID NO: 511 - protein, 24 aa, Homo sapiens
MVYQASWTSLDLHSPMRSTLLAYR

SEQ ID NO: 512 - protein, 22 aa, Homo sapiens
MSPSRAPLKERRPLYKYHSRLS

SEQ ID NO: 513 - protein, 33 aa, Homo sapiens
MSLPLGTAGSCPRLFGSKLESNSPQRKICCGKH

SEQ ID NO: 514 - protein, 123 aa, Homo sapiens
MKAVLLALLMAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

SEQ ID NO: 515 - DNA, 990 bp, Homo sapiens
  misc_feature (1)..(990): n = A,T,C or G
agggagaggcagtgaccatgaaggctgtgctgcttgccctgttgatggcaggcttggccctgcagccaggcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgccgccatccttgcgctgctccctgcactcggcctgctgctctggggacccggccagctataggctctggggggccccgctgcagcccacactgggtgtggtgccccaggcctttgtgccactcctcacagaacctggcccagtgggagcctgtcctggttcctgaggcacatcctaacgcaagtttgaccatgtatgtttgcaccccttttccccnaaccctgaccttcccatgggccttttccaggattccnaccnggcagatcagttttagtganacanatccgcntgcagatggcccctccaaccntttntgttgntgtttccatggcccagcattttccacccttaaccctgtgttcaggcacttnttcccccaggaagccttccctgcccaccccatttatgaattgagccaggtttggtccgtggtgtcccccgcacccagcaggggacaggcaatcaggagggcccagtaaaggctgagatgaagtggactgagtagaactggaggacaagagttgacgtgagttcctgggagtttccagagatggggcctggaggcctggaggaaggggccaggcctcacatttgtggggntcccgaatggcagcctgagcacagcgtaggcccttaataaacacctgttggataagccaaaaaa

SEQ ID NO: 516 - protein, 119 aa, Homo sapiens
MRLCCLPCWQAWPCSQALPCCATPAKPRATRTACRWRTAPSWGSSAGPRASAQLASPSSAKAAATAWMTHRTTTWARRTSRAVTPTCATPAGPMPCSRLPPSLRCSLHSACCSGDPASY

SEQ ID NO: 517 - DNA, 360 bp, Homo sapiens
atgaggctgtgctgcttgccctgttggcaggcttggccctgcagccaggcactgccctgctgtgctactcctgcaaagcccagggcaacgaggactgcctgcaggtggagaactgcacccagctgggggagcagtgctggaccgcgcgcatccgcgcagttggcctccccgtcatcagcaaaggctgcagctactgcgtggatgactcacaggactactacgtgggcaagaagaacatcacgtgctgtgacaccgacttgtgcaacgccagcggggcccatgccctgcagccggctgccgccatccttgcgctgctccctgcactcggcctgctgctctggggacccggccagctattga

SEQ ID NO: 518 - protein, 122 aa, Homo sapiens [sequence omitted]

SEQ ID NO: 519 - DNA, 369 bp, Homo sapiens
atggaaggctgtgctgcttgccctgttgatggcaggcttggccctgcagccaggcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggactcacaggactactacgtgggcaagaagaacatcacgtgctgcaccgacttgtgcaacgccagcggggcccatgccctgcagccggctgccgccatccttgcgctgctccctgcactcggcctgctgctctggggacccggccagctatatga

SEQ ID NO: 520 - protein, 71 aa, Homo sapiens
EGCAACPVDGRLGPAARHCPAVLLLQSPGEQRGLPAGGELHPAGGAVLDRAHPRSWPPDRHQQRLQLELRG

SEQ ID NO: 521 - protein, 51 aa, Homo sapiens
MTHRTTTWARRTSRAVTPTCATPAGPMPCSRLPPSLRCSLHSACCSGDPAS

SEQ ID NO: 522 - DNA, 28 bp, Homo sapiens
cctcattcctactcagcaacctccagcc

SEQ ID NO: 523 - DNA, 28 bp, Homo sapiens
gtccatcagccagaacaggaacgtagcc

SEQ ID NO: 524 - DNA, 25 bp, Homo sapiens
gttggatacaggccagactttgttg

SEQ ID NO: 525 - DNA, 23 bp, Homo sapiens
gagggtaggctggcctataggct

SEQ ID NO: 526 - protein, 13 aa, Homo sapiens
ESCTPPPGQGSKP

SEQ ID NO: 527 - protein, 15 aa, Homo sapiens
ELHPSSWPGQQALAL

SEQ ID NO: 528 - protein, 15 aa, Homo sapiens
SSWPGQQALALASCF

SEQ ID NO: 529 - protein, 16 aa, Homo sapiens
GQQALALASCFCFFSG

SEQ ID NO: 530 - protein, 14 aa, Homo sapiens
METEVPLTPFPLTP

SEQ ID NO: 531 - protein, 17 aa, Homo sapiens
MATRIWPTHPAGHGAAL

SEQ ID NO: 532 - protein, 15 aa, Homo sapiens
MSPINMNRFIFEAQT

SEQ ID NO: 533 - protein, 15 aa, Homo sapiens
NMNRFIFEAQTLTGL

SEQ ID NO: 534 - protein, 15 aa, Homo sapiens
MARTFLEFGVKSTTL

SEQ ID NO: 535 - protein, 15 aa, Homo sapiens
FLEFGVKSTTLYIVR

SEQ ID NO: 536 - protein, 15 aa, Homo sapiens
GVKSTTLYIVRVFTI

SEQ ID NO: 537 - protein, 15 aa, Homo sapiens
TTLYIVRVFTISLYP

SEQ ID NO: 538 - protein, 15 aa, Homo sapiens
IVRVFTISLYPPGPL

SEQ ID NO: 539 - protein, 14 aa, Homo sapiens
FTISLYPPGPLRTP

SEQ ID NO: 540 - protein, 15 aa, Homo sapiens
MEFTSRKRNLGSKGV

SEQ ID NO: 541 - protein, 15 aa, Homo sapiens
SRKRNLGSKGVSWSM

SEQ ID NO: 542 - protein, 16 aa, Homo sapiens
NLGSKGVSWSMKSSIT

SEQ ID NO: 543 - protein, 14 aa, Homo sapiens
MFTTDSFLPMLLAT

SEQ ID NO: 544 - protein, 15 aa, Homo sapiens
MRRSTSRIPSCYLAA

SEQ ID NO: 545 - protein, 15 aa, Homo sapiens
TSRIPSCYLAAALAV

SEQ ID NO: 546 - protein, 15 aa, Homo sapiens
PSCYLAAALAVLWRG

SEQ ID NO: 547 - protein, 15 aa, Homo sapiens
LAAALAVLWRGLLSW

SEQ ID NO: 548 - protein, 14 aa, Homo sapiens
LAVLWRGLLSWLAL

SEQ ID NO: 549 - DNA, 1629 bp, Homo sapiens
gttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacacaaaaaaaaaaaaaaaaaaaaaaaaaaaa

SEQ ID NO: 550 - protein, 142 aa, Homo sapiens
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAKKVRRAIEQLAAMD

SEQ ID NO: 551 - protein, 73 aa, Homo sapiens
WVPRRCPLPGSPFSRTTASLHSRTGPSWRAAPAPRSGWPRLASSTAPLRTSQTWPSVSSASRSWKAGSQMTTP

SEQ ID NO: 552 - protein, 47 aa, Homo sapiens
GCPDVAPCLAALSQGPPHLYIQELALLGGLRLHPGADGRGWLHPLPH

SEQ ID NO: 553 - protein, 135 aa, Homo sapiens [sequence omitted]

SEQ ID NO: 554 - DNA, 408 bp, Homo sapiens
atgtgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccaaggaacataaaaagcattcgtccggttgcgctttcctttctgtcaagaagcagtttgaagaataactggacagagaaagagccaagaacaaaattgcaaaggaaaccaacaataagaagaaagaatttgaggaaactgcgaagaaagtgcgccgtgccatcgagcagctggctgccatggatttga

SEQ ID NO: 555 - protein, 121 aa, Homo sapiens [sequence omitted]

SEQ ID NO: 556 - DNA, 366 bp, Homo sapiens
atggggtgccccgacgttgccccctgcctggcagccctttctcaaggaccaccgcatctctacattcaagaactggcccttcttggagggctgcgcctgcaccccggagcggatggccgaggctggcttcatccactgccccacgaacgagccagacttggcccagtgtttcttctgcttcaaggagctggaaggctgggagccagaaaagcattcgtccggttgcgctttcctttctgtcaagaagcagttatttttgaaactggacagagaaagagccaagaacaaaattgcaaaggaaaccaacaaggaaactgcgaagaaagtgcgccgtgccatcgagcagctggctgccatggattgtga

SEQ ID NO: 557 - DNA, 2970 bp, Homo sapiens
ggggtaaggagttcaaggcagcgcccacacccgggggctctccgcaacccgaccgcctgtccgctcccccacttcccgccctccctcccacctactcattcacccacccacccacccagagccgggacggcagcccaggcgcccgggccccgccgtctcctcgccgcgatcctggacttcctcttgctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagcctcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaagcttgtcagcgaaagttctcccggtccgaccacctgaagacccacaccaggactcatacaggtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtctggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaagaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaaaaaaaaaaaaaaa

SEQ ID NO: 558 - protein, 429 aa, Homo sapiens
MGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKACQRKFSRSDHLKTHTRTHTGEKPFSCRWPSCQKKFARSDELVRHHNMHQRNMTKLQLAL

SEQ ID NO: 559 - protein, 128 aa, Homo sapiens
GLRRAGPERAAARRPLPGWRRRLCPACERRGAVGAGAGLCAPGRFGLRVVGRPRAATGSAATPAAAASLLHQTGAELGRRGAARGAVPERLHCPLFRPVHWHSRSLSLRALRSSSAQPGVIRPGQDVS

SEQ ID NO: 560 - protein, 50 aa, Homo sapiens
MRRSSPTTHSSMRIPWASRARWVSSSTRCRPRSMAATPPPTAAPAARLCC

SEQ ID NO: 561 - protein, 23 aa, Homo sapiens
MHDLESDELRSHLKGPQHRVRER

SEQ ID NO: 562 - protein, 395 aa, Homo sapiens
MWAPTCGTTRCCPPSPPWVAAAAVPCLAARRSGRRCWTLRPRALRLTGRWAAPRRHRLRRHPRRRRLTPSSNRSRAGAARSRTRSSAAPSLSTFPASSLAQPEPVATGPSVLLRPARRHPARPGCFLTRPTCPAASRASPLFAIRVTARSPSTGRPATVTRPRTMRRSSPTTHSSMRIPWASRARWVSSSTRCRPRSMAATPPPTAAPAARLCCGRPTAVTIYTKRATAQGTRAITTQRPSSAEPNTEYTRTVSSEAFRMCDVCLEPRLLYGRHLRPVRNAPSCVLTQAAIRDILSCPTYRCTAGSTLVRNHTSVTSRTVNEGFLVQTSSKDTKGDIQVNHSSVKLVSESSPGPTTRPTPGLIQVKSPSAVGGQVVRKSLPGQMNSAITTCIRET

SEQ ID NO: 563 - DNA, 1185 bp, Homo sapiens
atgtgggctccgacgtgcgggaccacgcgctgctgcccgccgtcccctccctgggtggcggcggcggctgtgccctgcctggcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgccgcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgcggacgccctacagcagtgacaatttataccaaaagggccacagcacagggtacgagagcgataaccacacaacgcccatcctctgcggagcccaatacagaatacacacgcacggtgtcttcagaggcattcaggatgtgcgacgtgtgcctggagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgaaccattccagtgtaaagcttgtcagcgaaagttctcccggtccgaccaccagacccacaccaggactcatacaggtgaaaagcccttcagctgtcggtggccaagttgtcagaaaaagtttgcccggtcagatgaattccgccatcacaacatgcatcagagaaaca

SEQ ID NO: 564 - protein, 399 aa, Homo sapiens [sequence omitted]

SEQ ID NO: 565 - DNA, 1200 bp, Homo sapiens
atggggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcccgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcaggatcccatgggccagcagggctcgctggggcagcagtactcggtgccgcccccggtctatggctgccacacccccaccgacagctgcaccggcagccaggctttgctgctgaggacgccctacagcagcaatttataccaaatgacatcccagctatgcatgacctggaatcagatgaacttaggagccaccttaaagggccacagcacagggtacgagagcgaccacacaacgcccatcctctgcggagcccaatacagaatacacacgcacggtgtcttcagaggcattcaggatgtgcgacgtgtgcctggagtagccccgactcttgtacggtcggcatcgaaacgccccttcatgtgtgcttacccaggctgcaagctgtcccacttacagatgcacagcaggaagcacactggacgaaggttttctcgttcagaccagctcaaaagacaccaaaggagacatacaggtgtgaaaccattccagtgagcttgtcagcgaaagttctcccggtccgaccacctgaagacccacaccaggactcatacaggaaagcccttcagctgtcggtggccaagttgtcagaaaaagtttgcccggtcagaattagtccgccatcacaacatgcatcagagaaacatgaccaaactccagctggcgcttga

SEQ ID NO: 566 - DNA, 1905 bp, Homo sapiens
ggcacgagagcttacagcctgagaagagcgtctcgcccgggagcggcggcggccatcgagacccaaccccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaaaaaaaaaaaaaaaaaaaaa

SEQ ID NO: 567 - protein, 221 aa, Homo sapiens
MALALAALAAVEPACGSRYQQLQNEEESGEPEQAAGDAPPPYSSISAESAAYFDYKDESGFPKPPSYNVATTLPSYDEAERTKAEATIPLVPGRDEDFVGRDDFDDADQLRIGNDGIFMLTFFMAFLFNWIGFFLSFCLTTSAAGRYGAISGFGLSLIKWILIVRFSTYFPGYFDGQYWLWWVFLVLGFLLFLRGFINYAKVRKMPETFSNLPRTRVLFIY

SEQ ID NO: 568 - protein, 30 aa, Homo sapiens
WRWRWRRWRRSSRPAAAGTSSCRMKKSLEN

SEQ ID NO: 569 - protein, 23 aa, Homo sapiens
GVGVGGAGGGRAGLRQPVPAVAE

SEQ ID NO: 570 - protein, 45 aa, Homo sapiens
MKKSLENLNRLQVMLLHLTAAFLQRAQHILTTRMSLGFQSPHLTM

SEQ ID NO: 571 - protein, 34 aa, Homo sapiens
MMKRRGPRLKLLSLWFLGEMRILWVGMILMMLTS

SEQ ID NO: 572 - protein, 10 aa, Homo sapiens
MGPFQDLVSL

SEQ ID NO: 573 - protein, 15 aa, Homo sapiens
MDPDCQVFHLFPWIF

SEQ ID NO: 574 - protein, 12 aa, Homo sapiens
MVSTGSGGCSLF

SEQ ID NO: 575 - protein, 201 aa, Homo sapiens [sequence omitted]

SEQ ID NO: 576 - DNA, 606 bp, Homo sapiens
atgtggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgctacaacactgcccagttatgatgaagcggagaggaccaaggctgaagctactatccctttggttcctgggagagatgaggattttgtgggtcgggatgattttgatgatgctgaccagccttttttcatggcattcctctttaactggattgggtttttcctgtctttttgccccacttcagctgcaggaaggtatggggccatttcaggatttggtctctctcttgtcaggttttccacctatttccctggatattttgatggtcagtactggctctggtgggtgttccttgtttgctttctcctgtttctcagaggatttatcaattatgcaaaagttcggaagatgccagaaactttctcaaatctccccaggaccagagttctctttattttga

SEQ ID NO: 577 - protein, 171 aa, Homo sapiens [sequence omitted]

SEQ ID NO: 578 - DNA, 516 bp, Homo sapiens
atgggcgttggcgttggcggcgctggcggcggtcgagccggcctgcggcagccggtaccagcagttgcagaatgctcctccaccttacagcagcatttctgcagagagcgcagcatatttgtctgggtttccaaagcccccatcttacaatgtagctacaacactgcccagttaagctactatccctttggttcctgggagagatgggattttcatgttaacttttttcatggcattcctcttctggattgggtttttcctgtctttttgcctgaccacttcagctgcaggaaggtatggggccatttcaggatttggtctctctctaatatggatcctgattgtcaggttttccacctatttccctggatattttggtcagtactggctctggtgggtgttccttgttttaggctttctcctgtttctcagaggatttatcaattatgcaaaagttcggaagatgccagaaactttctcaaatctccccaggaccagagttctctttatttatga

SEQ ID NO: 579 - DNA, 1054 bp, Homo sapiens
cgcagcctccaaagccgccttcctcagggaaatttgcgtgaccttactgccctccgtctacaggccttgtacctctccaggccgatttttccacaatttaaatcccagttcacctggtatccagctccagcaacttagagcgtttcacgtcacgccgggcgccaggcgtcggcttgtataacctgaaaacgctcctgtttttctcatctgtgcagtgggttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactc

SEQ ID NO: 580 - protein, 213 aa, Homo sapiens
MAITQFRLFKFCTCLATVFSFLKRLICRSGRGRKLSGDQITLPTTVDYSSVPKQTDVEEWTSWDEDAPTSVKIEGGNGNVATQQNSLEQLEPDYFKDMTPTIRKTQKIVIKKREPLNFGIPDGSTGFSSRLAATQDLPFIHQSSELGDLDTWQENTNAWEEEEDAAWQAEEVLRQQKLADREKRAAEQQRKKMEKEAQRLMKKEQNKIGVKLS

SEQ ID NO: 581 - protein, 14 aa, Homo sapiens
WPSPSFGYLNFVPA

SEQ ID NO: 582 - protein, 20 aa, Homo sapiens
MQIWQRTEIKWRPNNFANYS

SEQ ID NO: 583 - protein, 15 aa, Homo sapiens
MLKSGLPGMKMHPPV

SEQ ID NO: 584 - protein, 21 aa, Homo sapiens
MGMWQHNKILWNNWNLTILRT

SEQ ID NO: 585 - protein, 9 aa, Homo sapiens
MGAQVSLVD

SEQ ID NO: 586 - protein, 16 aa, Homo sapiens
MHGKKKKMQPGKQKKF

SEQ ID NO: 587 - protein, 56 aa, Homo sapiens
MGRRRRCSLASRRSSETAETSRQRKESSRTTKEENGKGSTTANEEGTKQNWCETFI

SEQ ID NO: 588 - protein, 169 aa, Homo sapiens [sequence omitted]

SEQ ID NO: 589 - DNA, 510 bp, Homo sapiens
atgtggccatcacccagtttcggttatttaaattttgtacctgcctatgcagatctggcagaggacggaaatctttgccaactacagttgattattcatcagttcctaagcagacagatgttgaagagtggacttcctgggatgaagatgcacccaccagtgagatcgaaggagggaatgggaatgtggcaacacaacaaaattctttggaacaactggaacctgactattttaaggacacaccaactattaggaaaactcagaaaattgttattaagaagagagaaccatattttggcatcccagatgggagcacaggtttctctagtagatcagctacacaagatctgccttttattcatcagtcttctgaatatacctggcaggaaaataccaatgcatgggaagaagaagaagatgcagcctggcaagcagaagaagttccagacagagaaaagagagcagccgaacaacaaaggaagaaaatggaaaaggaagcacaacggctga

SEQ ID NO: 590 - protein, 170 aa, Homo sapiens [sequence omitted]

SEQ ID NO: 591 - DNA, 513 bp, Homo sapiens
atgggccatcacccagtttcggttattattttgtacctgcctagcaacagtattctcattcctaaagagattaatatgcagatctggcagaggacggaaattaagtggagaccaatgaataactttgccaactacagtagatgcacccaccagtgtaaagatcgaaggagggaatgggaatgtggcaacacaacaaaattctttggaacaactggaaccgaagagagaaccattgaattttggcatcccagatgggagcacaggtttctcattagcagctacacaagatctgccttttattcatcagtcttccttagatacctggcaggaaaataccaatgcatgggaagaagaagaagatgcagcctggcaagcagaagaagttctgagacagcagaaactagcagacagagaaaagagagcagccgaacaacaaaggaagaaaatggaaaaggaagcacaacggctaatgaagaaggaacaaaacaaaattggtgtgaaactttcatatga

SEQ ID NO: 592 - DNA, 5128 bp, Homo sapiens
actctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccagtgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagaagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgagttatcatgaattttaaagtatgcattattaaattgtaaaactccaaggtgatgttgtacctcttttgcttgccaaagtacagaatttgaattatcagcaaagaaaaaaaaaaaagccagccaagctttaaattatgtgaccataatgtactgatttcagtaagtctcataggttaaaaaaaaaagtcaccaaatagtgtgaaatatattacttaactgtccgtaagcagtatattagtattatcttgttcaggaaaaggttgaataatatatgccttgtgtaatattgaaaattgaaaagtacaactaacgcaaccaagtgtgctaaaaatgagcttgattaaatcaaccacctatttttgacatggaaatgaagcagggtttcttttcttcactcaaattttggcgaatctcaaaattagatcctaagatgtgttcttatttttataacatctttattgaaattctatttataatacagaatcttgttttgaaaataacctaattaatatattaaaattccaaattcatggcatgcttaaattttaactaaattttaaagccattctgattattgagttccagttgaagttagtggaaatctgaacattctcctgtggaaggcagagaaatctaagctgtgtctgcccaatgaataatggaaaatgccatgaattacctggatgttctttttacgaggtgacaagagttggggacagaactcccattacaactgaccaagtttctcttctagatgattttttgaaagttaacattaatgcctgctttttggaaagtcagaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtaccaaaattttaaaaaagggagtttttgatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaagaaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgaaaaaa

SEQ ID NO: 593 - protein, 543 aa, Homo sapiens
MGTSLSPNDPWPLNPLSIQQTTLLLLLSVLATVHVGQRLLRQRRRQLRSAPPGPFAWPLIGNAAAVGQAAHLSFARLARRYGDVFQIRLGSCPIVVLNGERAIHQALVQQGSAFADRPAFASFRVVSGGRSMAFGHYSEHWKVQRRAAHSMMRNFFTRQPRSRQVLEGHVLSEARELVALLVRGSADGAFLDPRPLTVVAVANVMSAVCFGCRYSHDDPEFRELLSHNEEFGRTVGAGSLVDVMPWLQYFPNPVRTVFREFEQLNRNFSNFILDKFLRHCESLRPGAAPRDMMDAFILSAEKKAAGDSHGGGARLDLENVPATITDIFGASQDTLSTALQWLLLLFTRYPDVQTRVQAELDQVVGRDRLPCMGDQPNLPYVLAFLYEAMRFSSFVPVTIPHATTANTSVLGYHIPKDTVVFVNQWSVNHDPVKWPNPENFDPARFLDKDGLINKDLTSRVMIFSVGKRRCIGEELSKMQLFLFISILAHQCDFRANPNEPAKMNFSYGLTIKPKSFKVNVTLRESMELLDSAVQNLQAKETCQ

SEQ ID NO: 594 - protein, 12 aa, Homo sapiens
WAPASARTTLGR

SEQ ID NO: 595 - protein, 53 aa, Homo sapiens
MASAPSTRPWCSRARPSPTGRPSPPSVWCPAAAAWLSATTRSTGRCSGAQPTA

SEQ ID NO: 596 - protein, 76 aa, Homo sapiens
MCRLECRQNWIRSWGGTVCLVWVTSPTCPMSWPSFMKPCASPALCLSLFLMPPLPTPLSWATTFPRTLWFLSTSGL

SEQ ID NO: 597 - protein, 25 aa, Homo sapiens
MSLSESPWSSLIVLSKIYKPRKLAN

SEQ ID NO: 598 - protein, 221 aa, Homo sapiens
GHQPQPERPLAAKPAVHPADHAPATPVGAGHCACGPAAAEATEAAAPVRAPGPVCVATDRKRGGGGPGGSPLVRSPGAALRRRFPDPPGQLPHSGAEWRARHPPGPGAAGLGLRRPAGLRLLPCGVRRPQHGFRPLLGALEGAAARSPQHDAQLLHAPAAQPPSPRGPRAERGARAGGAAGARQRGRRLPRPEAADRRGRGQRHECRVFRLPLQPRRPRVP

SEQ ID NO: 599 - protein, 503 aa, Homo sapiens
MWAPASARTTLGRTRCPSSRPRSCYSCRCWPLCMWASGCGNGGGSSGPRPRARLRGHSETRRRWARRLTSRSLAWRGATATFSRSAWAAAPMASAPSTRPWCSRARPSPTGRPSPPSVWCPAAAAWLSATTRSTGRCSGAQPTACATSSRASRAAAKSSRATCARRASWWRCWCAAARTAPSSTRGRVPCVSAAATATTTPSSVSCSATTKSSGARWARAAWWTCPGCSTSPTRCAPFSANSSSSTATSATSSWTSSGTAKAFGPGPPPATWTPLSSLRKRRRPGTRTVVARGWIWRTYRPLSLTSSAPARTPCPPRCSGCSSSSPGILMCRLECRQNWIRSWGGTVCLVWVTSPTCPMSWPSFMKPCASPALCLSLFLMPPLPTPLSWATTFPRTLWFLSTSGLSGLTRRTLIQLDSWTRMASSTRTFFQWAKGGALAKNFLRCSFFSSSPSWLTSAISGPTQMSLRKPLNPSHLKSMSLSESPWSSLIVLSKIYKPRKLAN

SEQ ID NO: 600 - DNA, 1512 bp, Homo sapiens
atgtgggcaccagcctcagcccgaacgacccttggccgcacccgctgtccatccagcagaccacgctcctgctactcctgtcggtgctggccactgtgcatgtgggccagcggctgcggcaacggaggcggcagctccggtccgcgcccccgggcccgtttgcgtggccactcggaaacgcggcggcggtgggccaggcggctcacctctcgttcgctcgcctggcgcggcgctacggcgacgttttccagatccgcctgggcagctgccccaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgcgcaacttcttcacgcgccagccgcgcagccgccaagtcctcgagggccacgtgcgcgaggcgcgcgagctggtggcgctgctggtgcgcggcagcgcggacggcgccttcctcgacccgaggccgcgtgccgtgtgtttcggctgccgctacagccacgacgaccccgagttccgtgagctgctcagccacaacgaagagttcgggcgcacggtgggcgcgggcagcctggtggacgtgccctggctgcagtacttccccaacccggtgcgcaccgttttccgcgaattcgagcagctcaaccgcaacttcagcaacttcatcctggacaagttctggcactgcgaaagccttcggcccggggccgccccccgcgacatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgagtggcctaacccggagaactttgatccagctcgattcttggacaaggatggcctcatcaacaaggaccttttttcagtgggcaaaaggcggtgcattggcgaagaactttctaagatgcagctttttctcttcatctccatcctggctcaccagtgcgatttcagggccaacccaaatgagcctgcgaaaaccattaaacccaagtcatttaaagtcaatgtcactctcagagagtccatggagctccttgatagtgctgtccaaaatttacaagccaaggaaacttgccaattga

SEQ ID NO: 601 - protein, 517 aa, Homo sapiens
MGHQPQPERPLAAKPAVHPADHAPATPVGAGHCACGPAAAEATEAAAPVRAPGPVCVATDRKRGGGGPGGSPLVRSPGAALRRRFPDPPGQLPHSGAEWRARHPPGPGAAGLGLRRPAGLRLLPCGVRRPQHGFRPLLGALEGAAARSPQHDAQLLHAPAAQPPSPRGPRAERGARAGGAAGARQRGRRLPRPEAADRRGRGQRHECRVFRLPLQPRRPRVPAAQPQRRVRAHGGRGQPGGRDALAAVLPQPGAHRFPRIRAAQPQLQQLHPGQVLEALRKPSARGRPPRHDGRLYPLCGKEGGRGLARWWRAAGFGERTGHYHHLRRQPGHPVHRAAVAAPPLHQVSCADSSAGRIGSGRGEGPSALYGPAQPALCPGLPLSHALLQLCACHYSSCHHCQHLCLGLPHSQGHCGFCQPVVCESSSSILGQGWPHQQGPDQQSDDFFSGQKAVHWRRTFDAAFSLHLHPGSPVRFQGQPKACENEFQLWSNHSQCHSQRVHGAPCCPKFTSQGNLPI

SEQ ID NO: 602 - DNA, 1554 bp, Homo sapiens
atggggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccggctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcaccatcttcggcgccagccaggacaccctgtccaccgcgctgcagtggctgctcctcctcttcaccaggtatcctgtgcagactcgagtgcaggcagaattggatcaggtcgtggggagggaccgtctgccttgtatgggccagcccaacctgccctatgtcctggccttcctttaagccatgcgcttctccagctttgtgcctgtcactattcctcatgccaccactgccaacacctctgtcttgggctaccacattcccaaggacactgtggtttttgtcaaccagtggtctgtgaatcatccagctcgattcttggacaaggatggcctcatcaacaaggacctgaccagcagagtgatgattttttcagtgggcaaaaggcggtgcattggcgaagaactttcgatgcagctttttctcttcatctccatcctggctcaccagtgcgatttcagggccaacccaaagcctgcgaaaatgaatttcagttatggtctaaccatagtcaatgtcactctcagagagtccatggagctccttgctgtccaaaatttacaagccaaggaaacttgccaatatga

SEQ ID NO: 603 - DNA, 47 bp, Homo sapiens
tccatattgtgcttccaccactgccaataacaaaataactagcaacc

SEQ ID NO: 604 - protein, 15 aa, Homo sapiens
HIVLPPLPITKLATM

SEQ ID NO: 605 - protein, 11 aa, Homo sapiens
HIVLPPLPITK

SEQ ID NO: 606 - protein, 14 aa, Homo sapiens
SILCFHHCQQNNQP

SEQ ID NO: 607 - protein, 9 aa, Homo sapiens
SILCFHHCQ

SEQ ID NO: 608 - protein, 16 aa, Homo sapiens
PYCASTTANNKITSNH

SEQ ID NO: 609 - DNA, 51 bp, Homo sapiens
ggccagagtgtcttgacagcacaccagagaaatccagggacctgaccgaag

SEQ ID NO: 610 - protein, 17 aa, Homo sapiens
GQSVLTAHQRNPGTPKM

SEQ ID NO: 611 - protein, 14 aa, Homo sapiens
GQSVLTAHQRNPGT

SEQ ID NO: 612 - protein, 16 aa, Homo sapiens
ARVSQHTREIQGPDRR

SEQ ID NO: 613 - protein, 12 aa, Homo sapiens
QHTREIQGPDRR

SEQ ID NO: 614 - protein, 17 aa, Homo sapiens
PECLDSTPEKSRDLTED

SEQ ID NO: 615 - DNA, 42 bp, Homo sapiens
gcccgtacacaccgtgtgctgggacaccccacagtcagccgc

SEQ ID NO: 616 - protein, 14 aa, Homo sapiens
ARTHRVLGHPTVSR

SEQ ID NO: 617 - protein, 14 aa, Homo sapiens
PVHTVCWDTPQSAA

SEQ ID NO: 618 - protein, 14 aa, Homo sapiens
PYTPCAGTPHSQPH

SEQ ID NO: 619 - DNA, 96 bp, Homo sapiens
cgaccagcagaccagacagtcacagcagccttgacaaaacgttcctggaactcaagcacttctccacagaggaggacagagcagacagcagagacc

SEQ ID NO: 620 - protein, 32 aa, Homo sapiens
RPADQTVTAALTKRSWNSSTSPQRRTEQTAET

SEQ ID NO: 621 - protein, 31 aa, Homo sapiens [sequence omitted]

SEQ ID NO: 622 - protein, 10 aa, Homo sapiens
DQQTRQSQQP

SEQ ID NO: 623 - protein, 21 aa, Homo sapiens
QNVPGTQALLHRGGQSRQQRP

SEQ ID NO: 624 - protein, 32 aa, Homo sapiens
TSRPDSHSSLDKTFLELKHFSTEEDRADSRDH

SEQ ID NO: 625 - DNA, 372 bp, Homo sapiens
actctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcagc

SEQ ID NO: 626 - protein, 121 aa, Homo sapiens
TLEWEWERALLRLQLEPQGHGNRHSPTPSLNLNAVRKPRLCQVPKGSGARRARHPSPSPSQSKRSWHRRQETRVGVKASSEGSRCPGRACGFLLTSCPRQRSQFLLGAGCPAPLETAPPRS

SEQ ID NO: 627 - protein, 15 aa, Homo sapiens
TLEWEWERALLRLQL

SEQ ID NO: 628 - protein, 45 aa, Homo sapiens
RHSPTPSLNLNAVRKPRLCQVPKGSGARRARHPSPSPSQSKRSWH

SEQ ID NO: 629 - protein, 54 aa, Homo sapiens
RRQETRVGVKASSEGSRCPGRACGFLLTSCPRQRSQFLLGAGCPAPLETAPPRS

SEQ ID NO: 630 - protein, 122 aa, Homo sapiens
LWSGSGSERFCDSSCESRKGMGIDATHRPPVSISTLGNLDFARSPRAAGLGERGTLLRPHPNPSAPGTDDAKRLEWELKLPVRAAGVQAGPAGSCRLALGKGPSSFSEPAVPRHWKPHLPAA

SEQ ID NO: 631 - protein, 36 aa, Homo sapiens
LWSGSGSERFCDSSCESRKGMGIDATHRPPVSISTL

SEQ ID NO: 632 - protein, 59 aa, Homo sapiens
GNLDFARSPRAAGLGERGTLLRPHPNPSAPGTDDAKRLEWELKLPVRAAGVQAGPAGSC

SEQ ID NO: 633 - protein, 27 aa, Homo sapiens
RLALGKGPSSFSEPAVPRHWKPHLPAA

SEQ ID NO: 634 - protein, 121 aa, Homo sapiens [sequence omitted]

SEQ ID NO: 635 - protein, 78 aa, Homo sapiens
SGVGVGASASATPVVRAARAWELTPLTDPQSQSQRCEETSTLPGPQGQRGSASEAPFSVPIPIQALLALTTPRDSSGS

SEQ ID NO: 636 - protein, 17 aa, Homo sapiens
GQQVSRPGLRVPVDVLP

SEQ ID NO: 637 - protein, 23 aa, Homo sapiens
AKVPVPSRSRLSRATGNRTSPQH

SEQ ID NO: 638 - DNA, 225 bp, Homo sapiens
cccgctctgcttcagcgcacgctgaagacggcactaggacccagggaagtccccgagcggggttcgcggaaaggcagccagactcctccttatctccagtgtcaaacttgacatcagcctgcgagcggagcatggtaacttctccagcaatcagagcgctccccctcacatcagtggcatgcttcatggagatatgctcctctcactgccctctgcaccagcaac

SEQ ID NO: 639 - protein, 73 aa, Homo sapiens
PALLQRTLKTALGPREVPERGSRKGSQTPPYLQCQTHQPASGAWLLQQSERSPSHQWHASWRYAPLTALCTSN

SEQ ID NO: 640 - protein, 36 aa, Homo sapiens
PALLQRTLKTALGPREVPERGSRKGSQTPPYLQCQT

SEQ ID NO: 641 - protein, 29 aa, Homo sapiens
LLQQSERSPSHQWHASWRYAPLTALCTSN

SEQ ID NO: 642 - protein, 73 aa, Homo sapiens [sequence omitted]

SEQ ID NO: 643 - protein, 63 aa, Homo sapiens
DPGKSPSGVRGKAARLLLISSVKLDISLRAEHGNFSSNQSAPPHISGMLHGDMLLSLPSAPAT

SEQ ID NO: 644 - protein, 75 aa, Homo sapiens
RSASAHAEDGTRTQGSPRAGFAERQPDSSLSPVSNLTSACERSMVTSPAIRALPLTSVACFMEICSSHCPLHQQH

SEQ ID NO: 645 - DNA, 150 bp, Homo sapiens
aattctcgagctcgtcgaccggtcgacgagctcgagggtcgacgagctcgagggcgcgcgcccggcccccacccctcgcagcaccccgcgccccgcgccctcccagccgggtccagccggagccatggggccggagccgcagtgagcacc

SEQ ID NO: 646 - protein, 50 aa, Homo sapiens
NSRARRPVDELEGRRARGRAPGPHPSQHPAPRALPAGSSRSHGAGAAVST

SEQ ID NO: 647 - protein, 49 aa, Homo sapiens
ILELVDRSTSSRVDELEGARPAPTPRSTPRPAPSQPGPAGAMGPEPQAP

SEQ ID NO: 648 - protein, 47 aa, Homo sapiens
ILELVDRSTSSRVDELEGARPAPTPRSTPRPAPSQPGPAGAMGPEPQ

SEQ ID NO: 649 - protein, 50 aa, Homo sapiens
FSSSSTGRRARGSTSSRARARPPPLAAPRAPRPPSRVQPEPWGRSRSEHH

SEQ ID NO: 650 - DNA, 424 bp, Homo sapiens
cctactctattcagatattctccagattcctaaagattagagatcatttctcattctcctaggagtactcacttcaggaagcaaccagataaaagagaggtgcaacggaagccagaacattcctcctggaaattcaacctgtttcgcagtttctcgaggaatcagcattcagtcaatccgggccgggagcagtcatctgtggtgaggctgattggctgggcaggaacagcgccggggcgtgggctgagcacagcgcttcgctctctttgccacaggaagcctgagctcattcgagtagcggctcttccaagctcaaagaagcagaggccgctgttcgtttcctttaggtctttccactaaagtcggagtatcttcttccaagatttcacgtcttggtggccgttccaaggagcgcgaggtcggg

SEQ ID NO: 651 - protein, 136 aa, Homo sapiens [sequence omitted]

SEQ ID NO: 652 - protein, 12 aa, Homo sapiens
LLYSDILQIPKD

SEQ ID NO: 653 - protein, 54 aa, Homo sapiens
RSFLILLGVLTSGSNQIKERCNGSQNIPPGNSTCFAVSRGISIQSIRAGSSHLW

SEQ ID NO: 654 - protein, 11 aa, Homo sapiens
LAGQEQRRGVG

SEQ ID NO: 655 - protein, 16 aa, Homo sapiens
AQRFALFATGSLSSFE

SEQ ID NO: 656 - protein, 42 aa, Homo sapiens
RLFQAQRSRGRCSFPLGLSTKVGVSSSKISRLGGRSKEREVG

SEQ ID NO: 657 - protein, 137 aa, Homo sapiens [sequence omitted]

SEQ ID NO: 658 - protein, 19 aa, Homo sapiens
YSIQIFSRFLKIRDHFSFS

SEQ ID NO: 659 - protein, 9 aa, Homo sapiens
EYSLQEATR

SEQ ID NO: 660 - protein, 63 aa, Homo sapiens
KRGATEARTFLLEIQPVSQFLEESAFSQSGPGAVICGEADWLGRNSAGAWAEHSASLSLPQEA

SEQ ID NO: 661 - protein, 20 aa, Homo sapiens
AHSSSGSSKLKEAEAAVRFL

SEQ ID NO: 662 - protein, 26 aa, Homo sapiens
VFPLKSEYLLPRFHVLVAVPRSARSG

SEQ ID NO: 663 - protein, 140 aa, Homo sapiens [sequence omitted]

SEQ ID NO: 664 - protein, 10 aa, Homo sapiens
PTLFRYSPDS

SEQ ID NO: 665 - protein, 108 aa, Homo sapiens
RLEIISHSPRSTHFRKQPDKREVQRKPEHSSWKFNLFRSFSRNQHSVNPGREQSSVVRLIGWAGTAPGRGLSTALRSLCHRKPELIRVAALPSSKKQRPLFVSFRSFH

SEQ ID NO: 666 - protein, 22 aa, Homo sapiens
SRSIFFQDFTSWWPFQGARGRD

SEQ ID NO: 667 - DNA, 121 bp, Homo sapiens
gtccaggagcaggtagctgctgggctccggggacactttgcgttcgggctgggagcgtgctttccacgacggtgacacgcttccctggattggcagccagactgccttccgggtcactgcc

SEQ ID NO: 668 - protein, 40 aa, Homo sapiens
  VARIANT (1)..(40): Xaa = Any Amino Acid
XSRSRLLGSGDTLRSGWERAFHDGDTLPWIGSQTAFRVTA

SEQ ID NO: 669 - protein, 35 aa, Homo sapiens
LLGSGDTLRSGWERAFHDGDTLPWIGSQTAFRVTA

SEQ ID NO: 670 - protein, 40 aa, Homo sapiens
PGAGSCWAPGTLCVRAGSVLSTTVTRFPGLAARLPSGSLP

SEQ ID NO: 671 - protein, 40 aa, Homo sapiens [sequence omitted]

SEQ ID NO: 672 - protein, 24 aa, Homo sapiens
VQEQVAAGLRGHFAFGLGACFPRR

SEQ ID NO: 673 - protein, 16 aa, Homo sapiens
HASLDWQPDCLPGHCH

SEQ ID NO: 674 - DNA, 235 bp, Homo sapiens
gcttcagggtacagctcccccgcagccagaagccgggcctgcagcccctcagcaccgctccgggacaccccacccgcttcccaggcgtgacctgtcaacagcaacttcgcggtgtggtgaactctctgaggaaaaaccattttgattattactctcagacgtgcgtggcaacaagtgactgagacctagaaatccaagcgttggaggtcctgaggccagcctaagtcgcttcaaa

SEQ ID NO: 675 - protein, 76 aa, Homo sapiens [sequence omitted]

SEQ ID NO: 676 - protein, 47 aa, Homo sapiens
LQGTAPPQPEAGPAAPQHRSGTPHPLPRRDLSTATSRCGELSEEKPF

SEQ ID NO: 677 - protein, 10 aa, Homo sapiens
LLLSDVRGNK

SEQ ID NO: 678 - protein, 19 aa, Homo sapiens
LRPRNPSVGGPEASLSRFK

SEQ ID NO: 679 - protein, 76 aa, Homo sapiens [sequence omitted]

SEQ ID NO: 680 - protein, 59 aa, Homo sapiens
FRVQLPRSQKPGLQPLSTAPGHPTRFPGVTCQQQLRGVVNSLRKNHFDYYSQTCVATSD

SEQ ID NO: 681 - protein, 13 aa, Homo sapiens
DLEIQALEVLRPA

SEQ ID NO: 682 - protein, 74 aa, Homo sapiens [sequence omitted]

SEQ ID NO: 683 - protein, 29 aa, Homo sapiens
ASGYSSPAARSRACSPSAPLRDTPPASQA

SEQ ID NO: 684 - protein, 9 aa, Homo sapiens
PVNSNFAVW

SEQ ID NO: 685 - protein, 19 aa, Homo sapiens
GKTILIITLRRAWQQVTET

SEQ ID NO: 686 - DNA, 261 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgag

SEQ ID NO: 687 - protein, 82 aa, Homo sapiens [sequence omitted]

SEQ ID NO: 688 - protein, 47 aa, Homo sapiens
LKRGRISFSWRQMLPLSLARIGSVHSRNTAVVEKLDPRSGANSSLQG

SEQ ID NO: 689 - protein, 31 aa, Homo sapiens
ERLYPAVVVGGRAVEQQHRRGSREAGSARAE

SEQ ID NO: 690 - protein, 86 aa, Homo sapiens
SKGAGFPSPGGRCCLSLSLGLVQCTLETLLWWRNWTPGLERIPACRADKRGISEIERDFTPPWWLEGAQSSSTGAGPGRPALLAPR

SEQ ID NO: 691 - protein, 69 aa, Homo sapiens
SKGAGFPSPGGRCCLSLSLGLVQCTLETLLWWRNWTPGLERIPACRADKRGISEIERDFTPPWWLEGAQ

SEQ ID NO: 692 - protein, 17 aa, Homo sapiens
SSSTGAGPGRPALLAPR

SEQ ID NO: 693 - protein, 86 aa, Homo sapiens
QKGPDFLLLEADVASLSRSDWFSALKHCCGGETGPQVWSEFQPAGLISEALVRLRETLPRRGGWRARSRAAAQARVPGGRLCSRRD

SEQ ID NO: 694 - protein, 25 aa, Homo sapiens
QKGPDFLLLEADVASLSRSDWFSAL

SEQ ID NO: 695 - protein, 61 aa, Homo sapiens
KHCCGGETGPQVWSEFQPAGLISEALVRLRETLPRRGGWRARSRAAAQARVPGGRLCSRRD

SEQ ID NO: 696 - DNA, 233 bp, Homo sapiens
cgcagcctccaaagccgccttcctcagggaaatttgcgtgaccttactgccctccgtctacaggccttgtacctctccaggccgatttttccacaatttaaatcccagttcacctggtatccagctccagcaacttagagcgtttcacgtcacgccgggcgccaggcgtcggcttgtataacctgaaaacgctcctgtttttctcatctgtgcagtgggttttgattcccacc

SEQ ID NO: 697 - protein, 75 aa, Homo sapiens [sequence omitted]

SEQ ID NO: 698 - protein, 12 aa, Homo sapiens
QPPKPPSSGKFA

SEQ ID NO: 699 - protein, 19 aa, Homo sapiens
PYCPPSTGLVPLQADFSTI

SEQ ID NO: 700 - protein, 44 aa, Homo sapiens
IPVHLVSSSSNLERFTSRRAPGVGLYNLKTLLFFSSVQWVLIPT

SEQ ID NO: 701 - protein, 75 aa, Homo sapiens [sequence omitted]

SEQ ID NO: 702 - protein, 45 aa, Homo sapiens
RSLQSRLPQGNLRDLTALRLQALYLSRPIFPQFKSQFTWYPAPAT

SEQ ID NO: 703 - protein, 15 aa, Homo sapiens
SVSRHAGRQASACIT

SEQ ID NO: 704 - protein, 12 aa, Homo sapiens
KRSCFSHLCSGF

SEQ ID NO: 705 - protein, 77 aa, Homo sapiens
AASKAAFLREICVTLLPSVYRPCTSPGRFFHNLNPSSPGIQLQQLRAFHVTPGARRRLVPENAPVFLICAVGFDSHH

SEQ ID NO: 706 - protein, 59 aa, Homo sapiens
AASKAAFLREICVTLLPSVYRPCTSPGRFFHNLNPSSPGIQLQQLRAFHVTPGARRRLV

SEQ ID NO: 707 - protein, 18 aa, Homo sapiens
PENAPVFLICAVGFDSHH

SEQ ID NO: 708 - DNA, 172 bp, Homo sapiens
ggcacgagagcttacagcctgagaagagcgtctcgcccgggagcggcggcggccatcgagacccaaccccaaggcgcgtccccctcggcctcccagcgctcccaagccgcagcggccgcgccccttcagctagctcgctcgctcgctctgcttccctgctgccggctgcgcc

SEQ ID NO: 709 - protein, 55 aa, Homo sapiens [sequence omitted]

SEQ ID NO: 710 - protein, 36 aa, Homo sapiens
EERLARERRRPSRPNPKARPPRPPSAPKPQRPRPFS

SEQ ID NO: 711 - protein, 13 aa, Homo sapiens
LARSLCFPAAGCA

SEQ ID NO: 712 - protein, 57 aa, Homo sapiens [sequence omitted]

SEQ ID NO: 713 - protein, 58 aa, Homo sapiens [sequence omitted]

SEQ ID NO: 714 - DNA, 55 bp, Homo sapiens
gcagcgctgcgtcctgctgcgcacgtgggaagccctggccccggccacccccgcg

SEQ ID NO: 715 - protein, 18 aa, Homo sapiens
QRCVLLRTWEALAPATPA

SEQ ID NO: 716 - protein, 18 aa, Homo sapiens
SAASCCARGKPWPRPPPR

SEQ ID NO: 717 - protein, 19 aa, Homo sapiens
AALRPAAHVGSPGPGHPRD

SEQ ID NO: 718 - DNA, 43 bp, Homo sapiens
aagaaaatcctgcttgacaaaaaccgtcacttaggaaaagatg

SEQ ID NO: 719 - protein, 13 aa, Homo sapiens
RKSCLTKTVTEKM

SEQ ID NO: 720 - protein, 10 aa, Homo sapiens
RKSCLTKTVT

SEQ ID NO: 721 - protein, 12 aa, Homo sapiens
ENPAQKPSLRKR

SEQ ID NO: 722 - protein, 14 aa, Homo sapiens
KKILLDKNRHLGKD

SEQ ID NO: 723 - DNA, 390 bp, Homo sapiens
ggggtaaggagttcaaggcagcgcccacacccgggggctctccgcaacccgaccgcctgtccgctcccccacttcccgccctccctcccacctactcattcacccacccacccacccagagccgggacggcagcccaggcgcccgggccccgccgtctcctcgccgcgatcctggacttcctcttgctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagcctcagcaa

SEQ ID NO: 724 - protein, 130 aa, Homo sapiens
GVRSSRQRPHPGALRNPTACPLPHFPPSLPPTHSPTHPPRAGTAAQAPGPRRLLAAILDFLLLQDPASTCVPEPASQHTLRSGPGCLQQPEQQGVRDPGGIWAKLGAAEASAERLQGRRSRGASGSEPQQ

SEQ ID NO: 725 - protein, 129 aa, Homo sapiens
  VARIANT (1)..(129): Xaa = Any Amino Acid
XGGVQGSAHTRGLSATRPPVRSPTSRPPSHLLIHPPTHPEPGRQPRRPGPAVSSPRSWTSSCCRTRLPRVSRSRRLSTRSAPGLGAYSSQSSRESGTRAASGPSAPPRPALNVSRAGGAAGRPGLSLSK

SEQ ID NO: 726 - protein, 102 aa, Homo sapiens
GVQGSAHTRGLSATRPPVRSPTSRPPSHLLIHPPTHPEPGRQPRRPGPAVSSPRSWTSSCCRTRLPRVSRSRRLSTRSAPGLGAYSSQSSRESGTRAASGPS

SEQ ID NO: 727 - protein, 25 aa, Homo sapiens
APPRPALNVSRAGGAAGRPGLSLSK

SEQ ID NO: 728 - protein, 128 aa, Homo sapiens [sequence omitted]

SEQ ID NO: 729 - protein, 111 aa, Homo sapiens
GKEFKAAPTPGGSPQPDRLSAPPLPALPPTYSFTHPPTQSRDGSPGARAPPSPRRDPGLPLAAGPGFHVCPGAGVSAHAPLRAWVPTAARAAGSPGPGRHLGQVRRRRGQR

SEQ ID NO: 730 - protein, 13 aa, Homo sapiens
TSPGPEEPRGVRV

SEQ ID NO: 731 - DNA, 35937 bp, AdenoVirus
catcatcataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgccggatgtggtaaaagtgacgtttttggtgtgcgccggtgtatacgggaagtgacaattttcgcgcggttttaggcggatgttgtagtaaatttgggcgtaaccaagtaatgtttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtcggtgatagagtggtgggtttggtgtggtaatttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgcttcatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaccagactctgtttggattttgatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccgagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaaccgtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgacttgcatgttttccctgaccaaatgcgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttaagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtcgccctcttcggcatcaaggaaggtgattggtttataggtgtaggccacgtgaccgggtgttcctgaaggggggctataaaagggggtgggggcgcgttcgtcctcactctcttccgcatcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgaacagaatggcggtagtgggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctaaccatgactttgaggtactggtatttgaagtcagtgtcgtcgcatccgccctgctcccagagcaaaaagtccgtgcgctttttggaacgcgggtttggcagggcgaaggtgacatcgttgaaaagtatctttcccgcgcgaggcataaagttgcgtgtgatgcggaagggtcccggcacctcggaacggttgttaattacctgggcggcgagcacgatctcgtcgaagccgttgatgttgtggcccacgatgtaaagttccaagaagcgcggggtgcccttgatggagggcaattttttaagttcctcgtaggtgagctcctcaggggagctgagcccgtgttctgacagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccacggctaggtctcgcgcggcggtcaccagaggctcatctccgccgaacttcataaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttatggtggatcggaccaccacgccgcgcgagcccaaagtccagatgtccgcgcgcggcggtcggagcttgatgacaacatcgcgcagatgggagctgtccatggtctggagctcccgcggcgacaggtcaggcgggagctcctgcaggtttacctcgcatagccgggtcagggcgcgggctaggtccaggtgatacctgatttccaggggctggttggtggcggcgtcgatgacttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatttcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcaatctcctcttccataagggcctccccttcttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctacggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactgatatcccaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtgaggcgtgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggctgctgcgctagcttttttggccactggccgcgcgcggcgtaagcggttaggctggaaagcgaaagcattaagtggctcgctccctgtagccggagggttattttccaagggttgagtcgcaggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctccccttctcctaccgcgtcaggaggggcaacatccgcggctgacgcggcggcagatggtgattacgaacccccgcggcgccgggcccggcactacctggacttggaggagggcgagggcctggcgcggctaggagcgccctctcctgagcgacacccaagggtgcagctgaagcgtgacacgcgcgaggcgtacgtgccgcggcagaacctgtttcgcgaccgcgagggagaggagcccgaggagatgcgggatcgaaagttccacgcagggcgcgagttgcggcatggcctgaaccgcgagcggttgctgcgcgaggaggactttgagcccgacgcgcggaccgggattagtcccgcgcgcgcacacgtggcggccgccgacctggtaaccgcgtacgagcagacggtgaaccaggagattaactttcaaaaaagctttaacaaccacgtgcgcacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacattctgcagagcatagtggtgcaggagcgcagcttgagcctggctgacaaggtggccgccattaactattccatgctcagtctgggcaagttttacgcccgcaagatataccataccccttacgttcccatagacaaggaggtaaagatcgaggggttctacatgcgcatggcgttgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgtaaccctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgatgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtccgggccagactattttttccagaccagtagacaaggcctgcagaccgtaaacctgagccaggctttcaagaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctgaactacctgctgaccaaccggcggcagaagatcccctcgttgcacagtttaaacagcgaggaggagcgcatcttgcgctatgtgcagcagagcgtgagccttaacctgatgcgcgacggggtaacgcccagcgtggcgctggacatgaccgcgcgcaacatggaaccgggcatgtatgcctcaaaccggccgtttatcaatcgcctaatggactacttgcatcgcgcggccgccgtgaaccccgagtatttcaccaatgccatcttgaacccgcactggctaccgccccctggtttctacaccgggggatttgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgcgagtagcccatttccaagcttgatagggtcttttaccagcactcgcaccacccgcccgcgcctgctgggcgaggaggagtacctaaacaactcgctgctgcagccgcagcgcgaaaagaacctgcctccggcatttcccaacaacgggatagagagcctagtggacaagatgagtagatggaagacgtatgcgcaggagcacagggatgtgcccggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaaaaaaagcatgatgcaaaataaaaaactcaccaaggccatggcaccgagcgttggttttcttgtattccccttagtatgcagcgcgcggcgatgtatgaggaaggtcctcctccctcctacgagagcgtggtgagcgcggcgccagtggcggcggcgctgggttcccccttcgatgctcccctggacccgccgtttgtgcctccgcggtacctgcggcctaccggggggagaaacagcatccgttactctgagttggcacccctattcgacaccacccgtgtgtaccttgtggacaacaagtcaacggatgtggcatccctgaactaccagaacgaccacagcaactttctaaccacggtcattcaaaacaatgactacagcccgggggaggcaagcacacagaccatcaatcttgacgaccgttcgcactggggcggcgacctgaaaaccatcctgcataccaacatgccaaatgtgaacgagttcatgtttaccaataagtttaaggcgcgggtgatggtgtcgcgctcgcttactaaggacaaacaggtggagctgaaatatgagtgggtggagttcacgctgcccgagggcaactactccgagaccatgaccatagaccttatgaacaacgcgatcgtggagcactacttgaaagtgggcaggcagaacggggttctggaaagcgacatcggggtaaagtttgacacccgcaacttcagactggggtttgacccagtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgacctggagggtggtaacattcccgcactgttggatgtggacgcctaccaggcaagcttaaaagatgacaccgaacagggcggggatggcgcaggcggcggcaacaacagtggcagcggcgcggaagagaactccaacgcggcagccgcggcaatgcagccggtggaggacatgaacgatcatgccattcgcggcgacacctttgccacacgggcggaggagaagcgcgctgaggccgaggcagcggcagaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccgggatccgctcatggaccctcctttgcactcctgacgtaacctgcggctcggagcaggtctactggtcgttgccagacatgatgcaagaccccgtgaccttccgctccacgagccagatcagcaactttccggtggtgggcgccgagctgttgcccgtgcactccaagagcttctacaacgaccaggccgtctactcccagctcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaaacatgtccatccttatatcgcccagcaataacacaggctggggcctgcgcttcccaagcaagatgtttggcggggcaaagaagcgctccgaccaacacccagtgcgcgtgcgcgggcactaccgcgcgccctggggcgcgcacaaacgcggccgcactgggcgcaccaccgtcgatgacgccattgacgcggtggtggaggaggcgcgcaactacacgcccacgccgccaccagtgtccacagtggacgcggccattcagaccgtggtgcgcggagcccggcgttatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtactgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgatgaacttgacgacgaggtggaactgctgcacgcaaccgcgcccaggcggcgggtacagtggaaaggtcgacgcgtaagacgtgttttgcgacccggcaccaccgtagtttttacgcccggtgagcgctccacccgcacctacaagcgcgtgtatgatgaggtgtacggcgacgaggacctgcttgagcaggccaacgagcgcctcggggagtttgcctacggaaagcggcataaggacatgttggcgttgccgctggacgagggcaacccaacacctagcctaaagcccgtgacactgcagcaggtgctgcccacgcttgcaccgtccgaagaaaagcgcggcctaaagcgcgagtctggtgacttggcacccaccgtgcagctgatggtacccaagcgccagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaaaacctctacggaggtgcaaacggacccgtggatgtttcgcgtttcagccccccggcgcccgcgccgttccaggaagtacggcaccgccagcgcactactgcccgaatatgccctacatccttccatcgcgcctacccccggctatcgtggctacacctaccgccccagaagacgagcgactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggagtctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccattaagaactatggcagcaaggcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcggcccgacagggaagaaactctggtgacgcaaatagatgagcctccctcgtacgaggaggcactaaagcaaggcctgcccaccacccgtcccatcgcgcccatggctaccggagtgctgggccagcacacacctgtaacgctggacctgcctccccccgctgacacccagcagaaacctgtgctgccagggccgtccgccgttgttgtaacccgccctagccgcgcgtccctgcgccgtgccgccagcggtccgcgatcgatgcggcccgtagccagtggcaactggcaaagcacactgaacagcatcgtgggtctgggggtgcaatccctgaagcgccgacgatgcttctaaatagctaacgtgtcgtatgtgtcatgtatgcgtccatgtcgccgccagaggagctgctgagccgccgtgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcacctacgcacgacgtaaccacagaccggtcccagcgtttgacgctgcggttcatccctgtggaccgcgaggataccgcgtactcgtacaaagcgcggttcaccctggctgtgggtgacaaccgtgtgcttgatatggcttccacgtactttgacatccgcggcgtgctggacagggggcctacttttaagccctactccggcactgcctacaacgctctagctcccaagggcgctcctaactcctgtgagtgggaacaaaccgaagatagcggccgggcagttgccgaggatgaagaagaggaagatgaagatgaagaagaggaagaagaagagcaaaacgctcgagatcaggctactaagaaaacacatgtctatgcccaggctcctttgtctggagaaacaattacaaaaagcgggctacaaataggatcagacaatgcagaaacacaagctaaacctgtatacgcagatccttcctatcaaccagaacctcaaattggcgaatctcagtggaacgaagctgatgctaatgcggcaggagggagagtgcttaaaaaaacaactcccatgaaaccatgctatggatcttatgccaggcctacaaatccttttggtggtcaatccgttctggttccggatgaaaaaggggtgcctcttccaaaggttgacttgcaattcttctcaaatactacctctttgaacgaccggcaaggcaatgctactaaaccaaaagtggttttgtacagtgaagatgtaaatatggaaaccccagacacacatctgtcttacaaacctggaaaaggtgatgaaaattctaaagctatgttgggtcaacaatctatgccaaacagacccaattacattgctttcagggacaattttattggcctaatgtattataacagcactggcaacatgggtgttcttgctggtcaggcatcgcagctaaatgccgtggtagatttgcaagacagaaacacagagctgtcctatcaactcttgcttgattccataggtgatagaaccagatatttttctatgtggaatcaggctgtagacagctatgatccagatgttagaatcattgaaaaccatggaactgaggatgaattgccaaattattgttttcctcttgggggtattggggtaactgacacctatcaagctattaaggctaatggcaatggctcaggcgataatggagatactacatggacaaaagatgaaacttttgcaacacgtaatgaaataggagtgggtaacaactttgccatggaaattaacctaaatgccaacctatggagaaatttcctttactccaatattgcgctgtacctgccagacaagctaaaatacaaccccaccaatgtggaaatatctgacaaccccaacacctacgactacatgaacaagcgagtggtggctcccgggcttgtagactgctacattaaccttggggcgcgctggtctctggactacatggacaacgttaatccctttaaccaccaccgcaatgcgggcctccgttatcgctccatgttgttgggaaacggccgctacgtgccctttcacattcaggtgccccaaaagttttttgccattaaaaacctcctcctcctgccaggctcatatacatatgaatggaacttcaggaaggatgttaacatggttctgcagagctctctgggaaacgatcttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctataccccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacctttgactcttctgttagctggccgggcaacgaccgcctgcttactcccaatgagtttgagattaaacgctcagttgacggggagggctacaacgtagctcagtgcaacatgaccaaggactggttcctggtgcagatgttggccaactacaatattggctaccagggcttctacattccagaaagctacaaggaccgcatgtactcgttcttcagaaacttccagcccatgagccggcaagtggttgacgatactaaatacaaggagtatcagcaggttggaattcttcaccagcataacaactcaggattcgtaggctacctcgctcccaccatgcgcgagggacaggcttaccccgccaacgtgccctacccactaataggcaaaaccgcggttgacagtattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcgctcaaaaacatgctacctctttgagccctttggcttttctgaccaacgactcaagcaggtttaccagtttgagtacgagtcactcctgcgccgtagcgccattgcttcttcccccgaccgctgtataacgctggaaaagtccacccaaagcgtgcaggggcccaactcggccgcctgtggactattctgctgcatgtttctccacgcctttgccaactggccccaaactcccatggatcacaaccccaccatgaaccttattaccggggtacccaactccatgcttaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactaggagacactttcaataaaggcaaatgtttttatttgtacactctcgggtgattatttaccccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccggtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcgtccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgacacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaggatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaaacgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgcctcgggcaaaacgtgcttcattccacgctcaagggcgaggcgcgccgcgactacgtccgcgactgcgtttacttatttctgtgctacacctggcaaacggccatgggcgtgtggcagcaatgcctggaggagcgcaacctaaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttctgcagctagccaactaccttgcctaccactccgacatcatggaagacgtgagcggtgacggcctactggagtgtcactgtcgctgcaacctatgcaccccgcaccgctccctggtctgcaattcgcaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccatcaacaaagcccgccaagagtttctgctacgaaagggacggggggtttacctggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaagcttccgaggccgaagaggtgtcagacgaaacaccgtcaccctcggtcgcattcccctcgccggcgccccagaaattggcaaccgttcccagcatcgctacaacctccgctcctcaggcgccgccggcactgcctgttcgccgacccaaccgtagatgggacaccactggaaccagggccggtaagtctaagcagccgccgccgttagcccaagagcaacaacagcgccaaggctaccgctcgtggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcggcagcaacagcagcggtcacacagaagcaaaggcgaccggatagcaagactctgacaaagcccaagaaatccacagcggcggcagcagcaggaggaggagcgctgcgtctggcgcccaacgaacccgtatcgacccgcgagcttagaaataggatttttcccactctgtatgctatatttcaacaaagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgctggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtgaaagactcggcggacggctacgactgaatgaccagtggagaggcagagcgactgcgcctgacacacctcgaccactgccgccgccacaagtgctttgcccgcggctccggtgagttttgttactttgaattgcccgaagagcatatcgagggcccggcgcacggcgtccggctcaccacccaggtagagcttacacgtagcctgattcgggagtttaccaagcgccccctgctagtggagcgggagcggggtccctgtgttctgaccgtggtttgcaactgtcctaaccctggattacatcaagatctttgttgtcatctctgtgctgagtataataaatacagaaattagaatctactggggctcctgtcgccatcctgtgaacgccaccgtttttacccacccaaagcagaccaaagcaaacctcacctccggtttgcacaagcgggccaataagtaccttacctggtactttaacggctcttcatttgtaatttacaacagtttccagcgagacgaagtaagtttgccacacaaccttctcggcttcaactacaccgtcaagaaaaacaccaccaccaccaccctcctcacctgccgggaacgtacgagtgcgtcaccggttgctgcgcccacacctacagcctgagcgtaaccagacattactcccatttttccaaaacaggaggtgagctcaactcccggaactcaggtcaaaaaagcattttgcggggtgctgggattttttaattaagtatatgagcaattcaagtaactctacaagcttgtctaatttttctggaattggggtcggggttatccttactcttgtaattctgtttattcttatactagcacttctgtgccttagggttgccgcctgctgcacgcacgtttgtacctattgtcagctttttaaacgctgggggcaacatccaagatgaggtacatgattttaggcttgctcgcccttgcggcagtctgcagcgctgccaaaaaggttgagtttaaggaaccagcttgcaatgttacatttaaatcagaagctaatgaatgcactactcttataaaatgcaccacagaacatgaaaagcttattattcgccacaaagacaaaattggcaagtatgctgtatatgctatttggcagccaggtgacactaacgactataatgtcacagtcttccaaggtgaaaatcgtaaaacttttatgtataaatttccattttatgaaatgtgcgatattaccatgtacatgagcaaacagtacaagttgtggcccccacaaaagtgtttagagaacactggcaccttttgttccaccgctctgcttattacagcgcttgctttggtatgtaccttactttatctcaaatacaaaagcagacgcagttttattgatgaaaagaaaatgccttgattttccgcttgcttgtattcccctggacaatttactctatgtgggatatgctccaggcgggcaagattatacccacaaccttcaaatcaaactttcctggacgttagcgcctgatttctgccagcgcctgcactgcaaatttgatcaaacccagcttcagcttgcctgctccagagatgaccggctcaaccatcgcgcccacaacggactatcgcaacaccactgctaccggactaacatctgccctaaatttaccccaagttcatgcctttgtcaatgactgggcgagcttggacatgtggtggttttccatagcgcttatgtttgtttgccttattattatgtggcttatttgttgcctaaagcgcagacgcgccagaccccccatctataggcctatcattgtgctcaacccacacaatgaaaaaattcatagattggacggtctgaaaccatgttctcttcttttacagtatgattaaatgagacatgattcctcgagttcttatattattgacccttgttgcgcttttctgtgcgtgctctacattggccgcggtcgctcacatcgaagtagattgcatcccacctttcacagtttacctgctttacggatttgtcacccttatcctcatctgcagcctcgtcactgtagtcatcgccttcattcagttcattgactgggtttgtgtgcgcattgcgtacctcaggcaccatccgcaatacagagacaggactatagctgatcttctcagaattctttaattatgaaacggagtgtcatttttgttttgctgattttttgcgccctacctgtgctttgctcccaaacctcagcgcctcccaaaagacatatttcctgcagattcactcaaatatggaacattcccagctgctacaacaaacagagcgatttgtcagaagcctggttatacgccatcatctctgtcatggttttttgcagtaccatttttgccctagccatatatccataccttgacattggctggaatgccatagatgccatgaaccaccctactttcccagtgcccgctgtcataccactgcaacaggttattgccccaatcaatcagcctcgccccccttctcccacccccactgagattagctactttaatttgacaggtggagatgactgaatctctagatctagaattggatggaattaacaccgaacagcgcctactagaaaggcgcaaggcggcgtccgagcgagaacgcctaaaacaagaagttgaagacatggttaacctacaccagtgtaaaagaggtatcttttgtgtggtcaagcaggccaaacttacctacgaaaaaaccactaccggcaaccgcctcagctacaagctacccacccagcgccaaaaactggtgcttatggtgggagaaaaacctatcaccgtcacccagcactcggcagaaacagagggctgcctgcacttcccctatcagggtccagaggacctctgcactcttattaaaaccatgtgtggtattagagatcttattccattcaactaacataaacacacaataaattacttacttaaaatcagtcagcaaatctttgtccagcttattcagcatcacctcctttccttcctcccaactctggtatctcagccgccttttagctgcaaactttctccaaagtttaaatgggatgtcaaattcctcatgttcttgtccctccgcacccactatcttcatattgttgcagatgaaacgcgccagaccgtctgaagacaccttcaaccccgtgtatccatatgacacagaaaccgggcctccaactgtgccctttcttacccctccatttgtttcacccaatggtttccaagaaagtccccctggagttctctctctacgcgtctccgaacctttggacacctcccacggcatgcttgcgcttaaaatgggcagcggtcttaccctagacaaggccggaaacctcacctcccaaaatgtaaccactgttactcagccacttaaaaaaacaaagtcaaacataagtttggacacctccgcaccacttacaattacctcaggcgccctaacagtggcaaccaccgctcctctgatagttactagcggcgctcttagcgtacagtcacaagccccactgaccgtgcaagactccaaactaagcattgctactaaagggcccattacagtgtcagatggaaagctagccctgcaaacatcagcccccctctctggcagtgacagcgacacccttactgtaactgcatcacccccgctaactactgccacgggtagcttgggcattaacatggaagatcctatttatgtaaataatggaaaaataggaattaaaataagcggtcctttgcaagtagcacaaaactccgatacactaacagtagttactggaccaggtgtcaccgttgaacaaaactcccttagaaccaaagttgcaggagctattggttatgattcatcaaacaacatggaaattaaaacgggcggtggcatgcgtataaataacaacttgttaattctagatgtggattacccatttgatgctcaaacaaaactacgtcttaaactggggcagggacccctgtatattaatgcatctcataacttggacataaactataacagaggcctatacctttttaatgcatcaaacaatactaaaaaactggaagttagcataaaaaaatccagtggactaaactttgataatactgccatagctataaatgcaggaaagggtctggagtttgatacaaacacatctgagtctccagatatcaacccaataaaaactaaaattggctctggcattgattacaatgaaaacggtgccatgattactaaacttggagcgggtttaagctttgacaactcaggggccattacaataggaaacaaaaatgatgacaaacttaccctgtggacaaccccagacccatctcctaactgcagaattcattcagataatgactgcaaatttactttggttcttacaaaatgtgggagtcaagtactagctactgtagctgctttggctgtatctggagatctttcatccatgacaggcaccgttgcaagtgttagtatattccttagatttgaccaaaacggtgttctaatggagaactcctcacttaaaaaacattactggaactttagaaatgggaactcaactaatgcaaatccatacacaaatgcagttggatttatgcctaaccttctagcctatccaaaaacccaaagtcaaactgctaaaaataacattgtcagtcaagtttacttgcatggtgataaaactaaacctatgatacttaccattacacttaatggcactagtgaatccacagaaactagcgaggtaagcacttactctatgtcttttacatggtcctgggaaagtggaaaatacaccactgaaacttttgctaccaactcttacaccttctcctacattgcccaggaataaagaatcgtgaacctgttgcatgttatgtttcaacgtgtttatttttcaattgcagaaaatttcaagtcatttttcattcagtagtatagccccaccaccacatagcttatattgatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcgcttaagttcatgtcgctgtccagctgctgagccacaggctgctgtccaacttgcggttgctcaacgggcggcgaaggggaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcatgagacgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatgcactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgtcagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtctctgtctcaaaaggaggtaggcgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcagggtgaatctcctctataaacattccagcaccttcaaccatgcccaaataattttcatctcgccaccttatcaatatgtctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagcccctatgtaagcttgttgcatgggcggcgatataaaatgcaaggtgctgctcaaaaaatcaggcaaagcctcgcgcaaaaaagcaagcacatcgtagtcatgctcatgcagataaaggcaggtaagttccggaaccaccacagaaaaagacaccatttttctctcaaacatgtctgcgggttcctgcattaaacacaaaataaaataacaaaaaaaaacatttaaacattagaagcctgtcttacaacaggaaaaacaacccttataagcataagacggactacggccatgccggcgtgaccgtaaaaaaactggtcaccgtgattaaaaagcaccaccgacagttcctcggtcatgtccggagtcataatgtaagactcggtaaacacatcaggttggttaacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaaacctattaaaaaacaccactcgacacggcaccagctcaatcagtcacagtgtaaaaagggccaagtacagagcgagtatatataggactaaaaaatgacgtaacggttaaagtccacaaaaaacacccagaaaaccgcacgcgaacctacgcccagaaacgaaagccaaaaaacccacaacttcctcaaatcttcacttccgttttcccacgatacgtcacttcccattttaaaaaaactacaattcccaatacatgcaagttactccgccctaaaacctacgtcacccgccccgttcccacgccccgcgccacgtcacaaactccaccccctcattatcatattggcttcaatccaaaataaggtatattatgatgatg

SEQ ID NO: 732 - DNA, 35938 bp, AdenoVirus
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgtccttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccttggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtaatgttacattcgcagctgaagctaatgagtgcaccactcttataaaatgcaccacagaacatgaaaagctgcttattcgccacaaaaacaaaattggcaagtatgctgtttatgctatttggcagccaggtgacactacagagtataatgttacagttttccagggtaaaagtcataaaacttttatgtatacttttccattttatgaaatgtgcgacattaccatgtacatgagcaaacagtataagttgtggcccccacaaaattgtgtggaaaacactggcactttctgctgcactgctatgctaattacagtgctcgctttggtctgtaccctactctatattaaatacaaaagcagacgcagctttattgaggaaaagaaaatgccttaatttactaagttacaaagctaatgtcaccactaactgctttactcgctgcttgcaaaacaaattcaaaaagttagcattataattagaataggatttaaaccccccggtcatttcctgctcaataccattcccctgaacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtaacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 733 - DNA, 34794 bp, AdenoVirus
catcatcaataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaccaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatttggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgagaaattggtatttgaagtcgatgtcgtcacaggctccctgttcccagagttggaagtctacccgtttcttgtaggcggggttgggcaaagcgaaagtaacatcattgaagagaatcttaccggctctgggcataaaattgcgagtgatgcgaaaaggctgtggtacttccgctcgattgttgatcacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggatttgcatgtaggaatgatgaccaaagatctaccgccagtgctgtttgtaactggtcccgatactgacgaaaatgccggccaattgccattttttctggagtgacacagtagaaggttctggggtcttgttgccatcgatcccacttgagtttaatggctagatcgtgggccatgttgacgagacgctcttctcctgagagtttcatgaccagcatgaaaggaactagttgtttgccaaaggatcccatccaggtgtaagtttccacatcgtaggtcaggaagagtctttctgtgcgaggatgagagccgatcgggaagaactggatttcctgccaccagttggaggattggctgttgatgtgatggaagtagaagtttctgcggcgcgccgagcattcgtgtttgtgcttgtacagacggccgcagtagtcgcagcgttgcacgggttgtatctcgtgaatgagttgtacctggcttcccttgacgagaaatttcagtgggaagccgaggcctggcgattgtatctcgtgctcttctatattcgctgtatcggcctgttcatcttctgtttcgatggtggtcatgctgacgagcccccgcgggaggcaagtccagacctcggcgcgggaggggcggagctgaaggacgagagcgcgcaggctggagctgtccagagtcctgagacgctgcggactcaggttagtaggtagggacagaagattaacttgcatgatcttttccagggcgtgcgggaggttcagatggtacttgatttccacaggttcgtttgtagagacgtcaatggcttgcagggttccgtgtcctttgggcgccactaccgtacctttgttttttcttttgatcggtggtggctctcttgcttcttgcatgctcagaagcggtgacggggacgcgcgccgggcggcagcggttgttccggacccgagggcatggctggtagtggcacgtcggcgccgcgcacgggcaggttctggtactgcgctctgagaagacttgcgtgcgccaccacgcgtcgattgacgtcttgtatctgacgtctctgggtgaaagctaccggccccgtgagcttgaacctgaaagagagttcaacagaatcaatttcggtatcgttaacggcagcttgtctcagtatttcttgtacgtcaccagagttgtcctggtaggcgatctccgccatgaactgctcgatttcttcctcctgaagatctccgcgacccgctctttcgacggtggccgcgaggtcattggagatacggcccatgagttgggagaatgcattcatgcccgcctcgttccagacgcggctgtaaaccacggccccctcggagtctcttgcgcgcatcaccacctgagcgaggttaagctccacgtgtctggtgaagaccgcatagttgcataggcgctgaaaaaggtagttgagtgtggtggcaatgtgttcggcgacgaagaaatacatgatccatcgtctcagcggcatttcgctaacatcgcccagagcttccaagcgctccatggcctcgtagaagtccacggcaaaattaaaaaactgggagtttcgcgcggacacggtcaattcctcctcgagaagacggatgagttcggctatggtggcccgtacttcgcgttcgaaggctcccgggatctcttcttcctcttctatctcttcttccactaacatctcttcttcgtcttcaggcgggggcggagggggcacgcggcgacgtcgacggcgcacgggcaaacggtcgatgaatcgttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagcgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcttattaagtgcggatgggaatgcaggtccgttgaaattacacacaataacaaaacctggaacaataccttatccaccacatgggagccaggagttcccgagtggtacactgtctctgtccgaggtcctgacggttccatccgcattagtaacaacactttcattttttctgaaatgtgcgatctggccatgttcatgagcaaacagtattctctatggcctcctagcaaggacaacatcgtaacgttctccattgcttattgcttgtgcgcttgccttcttactgctttactgtgcgtatgcatacacctgcttgtaaccactcgcatcaaaaacgccaataacaaagaaaaaatgccttaacctctttctgtttacagacatggcttctcttacatctctcatatttgtcagcattgtcactgccgctcatggacaaacagtcgtctctatccctctaggacataattacactctcataggacccccaatcacttcagaggtcatctggaccaaactgggaagcgttgattactttgatataatctgcaacaaaacaaaaccaataatagtaacttgcaacatacaaaatcttacattgattaatgttagcaaagtttacagcggttactattatggttatgacagatacagtagtcaatatagaaattacttggttcgtgttacccagttgaaaaccacgaaaatgccaaatatggcaaagattcgatccgatgacaattctctagaaacttttacatctcccaccacacccgacgaaaaaaacatcccagattcaatgattgcaattgttgcagcggtggcagtggtgatggcactaataataatatgcatgcttttatatgcttgtcgctacaaaaagtttcatcctaaaaaacaagatctcctactaaggcttaacatttaatttctttttatacagccatggtttccactaccacattccttatgcttactagtctcgcaactctgacttctgctcgctcacacctcactgtaactataggctcaaactgcacactaaaaggacctcaaggtggtcatgtcttttggtggagaatatatgacaatggatggtttacaaaaccatgtgaccaacctggtagatttttctgcaacggcagagacctaaccattatcaacgtgacagcaaatgacaaaggcttctattatggaaccgactataaaagtagtttagattataacattattgtactgccatctaccactccagcaccccgcacaactactttctctagcagcagtgtcgctaacaatacaatttccaatccaacctttgccgcgcttttaaaacgcactgtgaataattctacaacttcacatacaacaatttccacttcaacaatcagcattatcgctgcagtgacaattggaatatctattcttgtttttaccataacctactacgcctgctgctatagaaaagacaaacataaaggtgatccattacttagatttgatatttaatttgttctttttttttttatttacagtatggtgaacaccaatcatggtacctagaaatttcttcttcaccatactcatttgtgcatttaatgtttgcgctactttcacagcagtagccacagcaaccccagactgtataggagcatttgcttcctatgcactttttgcttttgttacttgcatctgcgtatgtagcatagtctgcctggttattaattttttccaacttatagactggatccttgtgcgaattgcctacctgcgccaccatcccgaataccgcaaccaaaatatcgcggcacttcttagactcatctaaaaccatgcaggctatactaccaatatttttgcttctattgcttccctacgctgtctcaaccccagctgcctatagtactccaccagaacaccttagaaaatgcaaattccaacaaccgtggtcatttcttgcttgctatcgagaaaaatcagaaattcccccaaatttaataatgattgctggaataattaatataatctgttgcaccataatttcatttttgatataccccctatttgattttggctggaatgctcccaatgcacatgatcatccacaagacccagaggaacacattcccctacaaaacatgcaacatccaatagcgctaatagattacgaaagtgaaccacaacccccactactccctgctattagttacttcaacctaaccggcggagatgactgaaacactcaccacctccaattccgccgaggatctgctcgatatggacggccgcgtctcagaacagcgactcgcccaactacgcatccgccagcagcaggaacgcgcggccaaagagctcagagatgtcatccaaattcaccaatgcaaaaaaggcatattctgtttggtaaaacaagccaagatatcctacgagatcaccgctactgaccatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatacggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccacggtagcatatgcaaatcccaaccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataataaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattattgatgatg

SEQ ID NO: 734 - protein, 11 aa, Homo sapiens
RHEAAAPCQSR

SEQ ID NO: 735 - protein, 6 aa, Artificial Sequence
  Made in a lab from synthetic material
HHHHHH

SEQ ID NO: 736 - protein, 8 aa, Artificial Sequence
  Made in a lab from synthetic material
DYKDDDDK

SEQ ID NO: 737 - protein, 15 aa, Artificial Sequence
  Made in a lab from synthetic material
GAPPPPAAAHHHHHH

SEQ ID NO: 738 - protein, 9 aa, Artificial Sequence
  Made in a lab from synthetic material
AAAHHHHHH

What is claimed is:

1. A method for inhibiting proliferation of a tumor cell in a cancer patient having a tumor characterized by production of a TERT tumor-specific polypeptide, said method comprising the steps of
   (a) obtaining from said patient a sample containing antigen presenting cells (APCs);
   (b) isolating from said sample said APCs;
   (c) priming said isolated APCs ex vivo with a pool of alternative reading frame (ARF), overlapping-sequence peptides that are each encoded by a portion of a polynucleotide encoding said TERT tumor-specific polypeptide, in either reading frame 1 (rf1) or reading frame 2 (rf2), wherein the rf1 and rf2 ARF open reading frames start at position 3 of the TERT rf0 AUG start site utilized for normal translation initiation, wherein the primed APCs are capable of stimulating an immune response in vivo; and
   (d) administering said primed APCs to the patient, wherein said TERT tumor-specific polypeptide is encoded by a polynucleotide selected from SEQ ID NO: 4 and SEQ ID NO: 6, and the pool of alternative frame, overlapping sequence peptides are encoded by one or more of: (i) Pool 1, the rf1 and rf2 ARF open reading frames starting at position 2 and position 3, respectively, of the TERT rf0 AUG start site; (ii) Pool 2, the four open reading frames in the rf2 reading frame initiated by an AUG codon 3' with respect to the rf0 AUG start site, and (iii) Pool 3, the nine open reading frames in the rf1 reading frame initiated by an AUG codon 3' with respect to the rf0 AUG start site.

2. A method for inhibiting proliferation of a tumor cell in a cancer patient having a tumor characterized by production of a human prostatic acid phosphatase (hPAP) tumor-specific polypeptide, said method comprising the steps of
   (a) obtaining from said patient a sample containing antigen presenting cells (APCs);
   (b) isolating from said sample said APCs;
   (c) priming said isolated APCs ex vivo with a pool of alternative reading frame (ARF), overlapping-sequence peptides that are each encoded by a portion of a polynucleotide encoding said hPAP tumor-specific polypeptide, in either reading frame 1 (rf1) or reading frame 2 (rf2), wherein the rf1 and rf2 ARF open reading frames start at position 5 and position 3, respectively, of the hPAP rf0 AUG start site, wherein the primed APCs are capable of stimulating an immune response in vivo; and
   (d) administering said primed APCs to the patient, wherein said hPAP polypeptide is encoded by a polynucleotide selected from SEQ ID NO: 10 and SEQ ID NO: 12, and the pool of alternative reading frame, overlapping sequence peptides are encoded by one or more of: (i) Pool 1, the rf1 and rf2 ARF open reading frames starting at position 5 and position 3, respectively, of the hPAP rf0 AUG start site; and (ii) Pool 2, the seven rf1 or rf2 open reading frames initiated by an AUG codon 3' with respect to the rf0 AUG start site.

3. The method of claim 1 or claim 2, wherein said tumor cell is from a cancer selected from the group consisting of a soft tissue sarcoma, a lymphoma, a cancer of the brain, a cancer of the esophagus, a cancer of the uterus, cervix, a cancer of the bone, a cancer of the lung, a cancer of the endometrium, a cancer of the bladder, a cancer of the breast, a cancer of the larynx, a cancer of the colon/rectum, a cancer of the stomach, a cancer of the ovary, a cancer of the pancreas, a cancer of the adrenal gland, and a cancer of the prostate.

* * * * *

UNITED STATES PATENT AND TRADEMARK OFFICE
CERTIFICATE OF CORRECTION

PATENT NO. : 7,597,894 B2  Page 1 of 1
APPLICATION NO. : 10/794514
DATED : October 6, 2009
INVENTOR(S) : Graddis et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 1134 days.

Signed and Sealed this

Twenty-eighth Day of September, 2010

David J. Kappos
*Director of the United States Patent and Trademark Office*